United States Patent 11,098,302 (IDENTIFICATION OF POLYNUCLEOTIDES ASSOCIATED WITH A SAMPLE) - sequence listing, part 150

SEQ ID NO: 588557 - DNA, 505 bp, Homo sapiens
  misc_feature: HIJSMM301E02KL.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgcccctcggtcactctgttcccgcct

SEQ ID NO: 588558 - DNA, 483 bp, Homo sapiens; identical to SEQ ID NO: 547051
  misc_feature: HIJSMM301BK31A.46.26.C04.1.454.light.4.raw

SEQ ID NO: 588559 - DNA, 513 bp, Homo sapiens; identical to SEQ ID NO: 545469
  misc_feature: HIJSMM301BVV9Q.8.23.C01.1.454.light.4.raw

SEQ ID NO: 588560 - DNA, 489 bp, Homo sapiens
  misc_feature: HIJSMM301BQLTG.14.56.F01.1.454.light.4.raw
cgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactagtggctgcaccatctgtt

SEQ ID NO: 588561 - DNA, 501 bp, Homo sapiens
  misc_feature: HIJSMM301CMGFK.49.29.C07.1.454.light.4.raw
agtcgagagacacgaccggtgctcgatttagagtgctacgaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaatcaacgaactgtggctgcaccatctgtcttcatcttcccgccat

SEQ ID NO: 588562 - DNA, 517 bp, Homo sapiens
  misc_feature: HIJSMM301ET1KQ.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctcggtcactctgttcccaccctcctcacg

SEQ ID NO: 588563 - DNA, 485 bp, Homo sapiens
  misc_feature: HIJSMM301CVJTS.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccgaacggtggagatcaaacgaactagtggctgcaccta

SEQ ID NO: 588564 - DNA, 489 bp, Homo sapiens; identical to SEQ ID NO: 544819
  misc_feature: HIJSMM301B76I0.11.28.C06.1.454.light.4.raw

SEQ ID NO: 588565 - DNA, 497 bp, Homo sapiens
  misc_feature: HIJSMM301AST5I.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagccctgcaggctgaagatgtggcagtttattactgtcagcaatattatattcctcctcagacgttcggccaagggaccaaggtggaaatcaaacgaactgtggctgcacc

SEQ ID NO: 588566 - DNA, 502 bp, Homo sapiens
  misc_feature: HIJSMM301AHXDH.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaactgaccgtcctaggtcacgccaaggctcgccccctc

SEQ ID NO: 588567 - DNA, 460 bp, Homo sapiens; identical to SEQ ID NO: 537107
  misc_feature: HIJSMM301AW2AR.22.28.C06.1.454.light.4.raw

SEQ ID NO: 588568 - DNA, 485 bp, Homo sapiens; identical to SEQ ID NO: 536576
  misc_feature: HIJSMM301CADAX.46.35.D02.1.454.light.4.raw

SEQ ID NO: 588569 - DNA, 442 bp, Homo sapiens; identical to SEQ ID NO: 535714
  misc_feature: HIJSMM301C2IX9.11.3.A03.1.454.light.4.raw

SEQ ID NO: 588570 - DNA, 507 bp, Homo sapiens
  misc_feature: HIJSMM301B8KJ0.48.15.B04.1.454.light.4.raw
agtatacatacacgaccggtgctcgatttagacagtatataccgcgggcacgaccggtgctcgatttagatcgtctgtgttgggtttggggggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaa

SEQ ID NO: 588571 - DNA, 485 bp, Homo sapiens; identical to SEQ ID NO: 536576
  misc_feature: HIJSMM301AOCD8.46.35.D02.1.454.light.4.raw

SEQ ID NO: 588572 - DNA, 482 bp, Homo sapiens
  misc_feature: HIJSMM301BEVO1.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgtcgtggttttggctgttcggcggcgggacc

SEQ ID NO: 588573 - DNA, 510 bp, Homo sapiens
  misc_feature: HIJSMM301C0T3G.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccgaagctcgaccgtcctgggtcagcccaaggcctcgccccctcggtccta

SEQ ID NO: 588574 - DNA, 482 bp, Homo sapiens
  misc_feature: HIJSMM301AHJ3N.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaaggtggagatcaaacgaactgtggctgcacat

SEQ ID NO: 588575 - DNA, 520 bp, Homo sapiens
  misc_feature: HIJSMM301BFSAF.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaaccccactgtcactctgttcccaccctcctccgtgt

SEQ ID NO: 588576 - DNA, 467 bp, Homo sapiens
  misc_feature: HIJSMM301C8PT7.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactacccaatcacttcggcctggactgaagtgcatatgaagagaactgtgg

SEQ ID NO: 588577 - DNA, 497 bp, Homo sapiens; identical to SEQ ID NO: 536371
  misc_feature: HIJSMM301A52FC.16.78.H01.1.454.light.4.raw

SEQ ID NO: 588578 - DNA, 470 bp, Homo sapiens; identical to SEQ ID NO: 536130
  misc_feature: HIJSMM301B71UB.7.81.H04.1.454.light.4.raw

SEQ ID NO: 588579 - DNA, 492 bp, Homo sapiens
  misc_feature: HIJSMM301CIQ6B.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggcctaggggaccaagctggagatcaaacgaactgt

SEQ ID NO: 588580 - DNA, 498 bp, Homo sapiens; identical to SEQ ID NO: 535295
  misc_feature: HIJSMM301D8VVQ.15.25.C03.1.454.light.4.raw

SEQ ID NO: 588581 - DNA, 485 bp, Homo sapiens
  misc_feature: HIJSMM301B3J5M.49.87.H10.1.454.light.4.raw
agtcgagagacacgaccggtgctcgatttagcagtactgcgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaacg

SEQ ID NO: 588582 - DNA, 489 bp, Homo sapiens
  misc_feature: HIJSMM301DPUFS.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaactttcggtcaggggaccaagttgaacatcaatcgaactgtggctgcaccat

SEQ ID NO: 588583 - DNA, 491 bp, Homo sapiens
  misc_feature: HIJSMM301CX57M.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaaggctgacagtcctaggtcagcccaaggctgcccccg

SEQ ID NO: 588584 - DNA, 497 bp, Homo sapiens; identical to SEQ ID NO: 539058
  misc_feature: HIJSMM301BG142.12.87.H10.1.454.light.4.raw

SEQ ID NO: 588585 - DNA, 509 bp, Homo sapiens; identical to SEQ ID NO: 550053
  misc_feature: HIJSMM301EFYZL.8.33.C11.1.454.light.4.raw

SEQ ID NO: 588586 - DNA, 503 bp, Homo sapiens; identical to SEQ ID NO: 551458
  misc_feature: HIJSMM301EVN61.19.78.H01.1.454.light.4.raw

SEQ ID NO: 588587 - DNA, 485 bp, Homo sapiens; identical to SEQ ID NO: 536576
  misc_feature: HIJSMM301C5C17.46.35.D02.1.454.light.4.raw

SEQ ID NO: 588588 - DNA, 513 bp, Homo sapiens
  misc_feature: HIJSMM301B5IT9.8.42.D09.1.454.light.4.raw
ctcgcgtgtccacgaccggtgctcgatttagacacatacgcaggggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaacctcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctcgccccctcggtcactctgttcccgccctcc

SEQ ID NO: 588589 - DNA, 514 bp, Homo sapiens
  misc_feature: HIJSMM301A4DLE.40.71.G05.1.454.light.4.raw
tctagcgactcacgaccggtgctcgatttagtgtcgtcgcaagagagaggggaggggggtgagggttgagaacctatgaacattctgtaggggccactgtcttctccacggtgctcccttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtccta

SEQ ID NO: 588590 - DNA, 449 bp, Homo sapiens; identical to SEQ ID NO: 574630
  misc_feature: HIJSMM301DNAPY.18.9.A09.1.454.light.4.raw

SEQ ID NO: 588591 - DNA, 480 bp, Homo sapiens
  misc_feature: HIJSMM301A4MOB.51.1.A01.1.454.light.4.raw
cgatcgtatacacgaccggtgctcgatttagacgtctcatcaggggcagtcccaaccaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaacctcctgatctatgctgcagccactttgcaaagtggagtcccatcgaggttcagtggcagtgggtctgggacagatttctctctcaccattagcagtctgcaacctgaagattttgcaacttactactgtcaacagagttacaatttgcccatcactttcggccaagggacacgactggagattaaacgaactgtggctgcaccatctgtctt

SEQ ID NO: 588592 - DNA, 453 bp, Homo sapiens
  misc_feature: HIJSMM301BN8B8.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctcggtcactctgttcccaccctcctccacgagagta

SEQ ID NO: 588593 - DNA, 486 bp, Homo sapiens; identical to SEQ ID NO: 564374
  misc_feature: HIJSMM301AIJ5Z.4.26.C04.1.454.light.4.raw

SEQ ID NO: 588594 - DNA, 494 bp, Homo sapiens; identical to SEQ ID NO: 559643
  misc_feature: HIJSMM301CUNRY.27.78.H01.1.454.light.4.raw

SEQ ID NO: 588595 - DNA, 487 bp, Homo sapiens
  misc_feature: HIJSMM301B5VMW.43.76.G10.1.454.light.4.raw
tgtgagtagtcacgaccggtgctcgatttagtcactcatacaggggactgcgggggtaagaggttgtgtccaccatggcctggactcctctcctcctcctgttcctctctcactgcacgggttccctctcgcaggctgtgctgactcagccgtcttccctctctgcatctcctggagcatcagccagtctcacctgcaccttgcgcgttggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggttttcggcggagggaccaagctgaccgtcctaagtcagacccg

SEQ ID NO: 588596 - DNA, 494 bp, Homo sapiens
  misc_feature: HIJSMM301B4BQ2.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtctgggtcagcccaaggctgccccctcggtcactc

SEQ ID NO: 588597 - DNA, 491 bp, Homo sapiens
  misc_feature: HIJSMM301CSABP.10.20.B09.1.454.light.4.raw
catagtagtgcacgaccggtgctcgatttagtgtagtgtgaagggggaggaactgctcagttaggacccagacggaaccatgggagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggtttattcactttcggccttgggaccaaagtggatttcagacgaactgtggctgcaccatctgtcttcta

SEQ ID NO: 588598 - DNA, 479 bp, Homo sapiens; identical to SEQ ID NO: 537163
  misc_feature: HIJSMM301D6IXV.13.73.G07.1.454.light.4.raw

SEQ ID NO: 588599 - DNA, 485 bp, Homo sapiens; identical to SEQ ID NO: 553490
  misc_feature: HIJSMM301D8SYT.46.35.D02.1.454.light.4.raw

SEQ ID NO: 588600 - DNA, 454 bp, Homo sapiens; identical to SEQ ID NO: 535005
  misc_feature: HIJSMM301EJUX6.19.86.H09.1.454.light.4.raw

SEQ ID NO: 588601 - DNA, 506 bp, Homo sapiens; identical to SEQ ID NO: 539926
  misc_feature: HIJSMM301CU4WW.5.24.C02.1.454.light.4.raw

SEQ ID NO: 588602 - DNA, 496 bp, Homo sapiens
  misc_feature: HIJSMM301C9JZ0.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtc

SEQ ID NO: 588603 - DNA, 385 bp, Homo sapiens; identical to SEQ ID NO: 539030
  misc_feature: HIJSMM301AO2D2.49.34.D01.1.454.light.4.raw

SEQ ID NO: 588604 - DNA, 517 bp, Homo sapiens
  misc_feature: HIJSMM301DN6ZM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgttcgtccgaacggacgaacggtaggaaggtacaaacgaactagtggctgcaccactctcgttcttctatcttcccgtccctact

SEQ ID NO: 588605 - DNA, 473 bp, Homo sapiens
  misc_feature: HIJSMM301CZKJD.7.81.H04.1.454.light.4.raw
cgtgtctctacacgaccggtgctcgatttagtagtgtagattcgcggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtgggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 588606 - DNA, 506 bp, Homo sapiens; identical to SEQ ID NO: 551204
  misc_feature: HIJSMM301EU7EA.15.59.F04.1.454.light.4.raw

SEQ ID NO: 588607 - DNA, 483 bp, Homo sapiens
  misc_feature: HIJSMM301C8ELC.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctcctgacaatctctgggctccaggctgacgacgaggctaattattactgctgctcatatgaaggttataacactatactattcggcggagggaccaagctgaccgtcctgcgtcagcccaaggctgccccctcggtcactctgttccccctcctccgctacgtaga

SEQ ID NO: 588608 - DNA, 519 bp, Homo sapiens
  misc_feature: HIJSMM301DHZ6B.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctcgccccctcggtcactctgttccccgcctcctcacg

SEQ ID NO: 588609 - DNA, 499 bp, Homo sapiens
  misc_feature: HIJSMM301BRM43.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtgaaattaaacgaactgtggctgcaccatctgtcttcatcttcccg

SEQ ID NO: 588610 - DNA, 496 bp, Homo sapiens
  misc_feature: HIJSMM301BHSS9.16.6.A06.1.454.light.4.raw
tgtactactccacgaccggtgctcgatttagatctactgacagggggagctacgaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactccttctgacgttcggccaagggaccaaggtggagatcaaacgaactgtggctgcaccat

SEQ ID NO: 588611 - DNA, 447 bp, Homo sapiens; identical to SEQ ID NO: 535201
  misc_feature: HIJSMM301BHQDU.18.9.A09.1.454.light.4.raw

SEQ ID NO: 588612 - DNA, 488 bp, Homo sapiens; identical to SEQ ID NO: 536861
  misc_feature: HIJSMM301DK4J2.12.88.H11.1.454.light.4.raw

SEQ ID NO: 588613 - DNA, 505 bp, Homo sapiens; identical to SEQ ID NO: 535503
  misc_feature: HIJSMM301AG6R8.8.28.C06.1.454.light.4.raw

SEQ ID NO: 588614 - DNA, 514 bp, Homo sapiens
  misc_feature: HIJSMM301EL31H.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccgaaggtggaagtcaagcgaactgtggctgcaccatctgtcttctatcttccccgtcccat

SEQ ID NO: 588615 - DNA, 478 bp, Homo sapiens; identical to SEQ ID NO: 583934
  misc_feature: HIJSMM301AZM4I.11.17.B06.1.454.light.4.raw

SEQ ID NO: 588616 - DNA, 463 bp, Homo sapiens; identical to SEQ ID NO: 535062
  misc_feature: HIJSMM301DF6UN.11.73.G07.1.454.light.4.raw

SEQ ID NO: 588617 - DNA, 515 bp, Homo sapiens
  misc_feature: HIJSMM301B07O7.43.23.C01.1.454.light.4.raw
tgtgagtagtcacgaccggtgctcgatttagtacacgtgattagggattgggggcgccaggggtcccttccaatatcagcaccatggcctggacttctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccctcctca

SEQ ID NO: 588618 - DNA, 484 bp, Homo sapiens; identical to SEQ ID NO: 538396
  misc_feature: HIJSMM301DG7PQ.15.1.A01.1.454.light.4.raw

SEQ ID NO: 588619 - DNA, 505 bp, Homo sapiens; identical to SEQ ID NO: 535503
  misc_feature: HIJSMM301BGKZS.8.28.C06.1.454.light.4.raw

SEQ ID NO: 588620 - DNA, 477 bp, Homo sapiens; identical to SEQ ID NO: 586043
  misc_feature: HIJSMM301CTGHN.7.81.H04.1.454.light.4.raw

SEQ ID NO: 588621 - DNA, 516 bp, Homo sapiens; identical to SEQ ID NO: 562329
  misc_feature: HIJSMM301C5N8T.5.27.C05.1.454.light.4.raw

SEQ ID NO: 588622 - DNA, 483 bp, Homo sapiens
  misc_feature: HIJSMM301CJVD0.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctcgttcccaccccctcgctagtaa

SEQ ID NO: 588623 - DNA, 504 bp, Homo sapiens; identical to SEQ ID NO: 567551
  misc_feature: HIJSMM301C4HZQ.18.78.H01.1.454.light.4.raw

SEQ ID NO: 588624 - DNA, 502 bp, Homo sapiens
  misc_feature: HIJSMM301EQ2NP.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcgagggaccaggctgaccgtcctgagtcagcccaaggctgcccccc

SEQ ID NO: 588625 - DNA, 499 bp, Homo sapiens; identical to SEQ ID NO: 545732
  misc_feature: HIJSMM301ELVQ7.3.33.C11.1.454.light.4.raw

SEQ ID NO: 588626 - DNA, 505 bp, Homo sapiens
  misc_feature: HIJSMM301BR50R.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtccta

SEQ ID NO: 588627 - DNA, 490 bp, Homo sapiens; identical to SEQ ID NO: 535234
  misc_feature: HIJSMM301BLRHV.17.21.B10.1.454.light.4.raw

SEQ ID NO: 588628 - DNA, 515 bp, Homo sapiens
  misc_feature: HIJSMM301D5A3Q.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctgggggtccctcctcggttttctggctccatcgacgggtcctccactactgcctccctcaccatctctggactgaagactgaggacgaggctgactactactgtcagtcttatgataacaccagggtggtgttcggcggagggacccaagctggccgtcctaggtcagcccaaggctgccccctcggtcactctgttcccaccctcctcgatagtaca

SEQ ID NO: 588629 - DNA, 499 bp, Homo sapiens; identical to SEQ ID NO: 537739
  misc_feature: HIJSMM301DIGJW.12.86.H09.1.454.light.4.raw

SEQ ID NO: 588630 - DNA, 516 bp, Homo sapiens
  misc_feature: HIJSMM301BHVDF.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcta

SEQ ID NO: 588631 - DNA, 484 bp, Homo sapiens; identical to SEQ ID NO: 535400
  misc_feature: HIJSMM301DOWW4.46.26.C04.1.454.light.4.raw

SEQ ID NO: 588632 - DNA, 497 bp, Homo sapiens; identical to SEQ ID NO: 535664
  misc_feature: HIJSMM301EEX0H.22.14.B03.1.454.light.4.raw

SEQ ID NO: 588633 - DNA, 504 bp, Homo sapiens; identical to SEQ ID NO: 546845
  misc_feature: HIJSMM301CD4SL.53.49.E05.1.454.light.4.raw

SEQ ID NO: 588634 - DNA, 483 bp, Homo sapiens
  misc_feature: HIJSMM301ADGCA.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccagggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccg

SEQ ID NO: 588635 - DNA, 500 bp, Homo sapiens; identical to SEQ ID NO: 541872
  misc_feature: HIJSMM301AH7Z5.48.82.H05.1.454.light.4.raw

SEQ ID NO: 588636 - DNA, 504 bp, Homo sapiens
  misc_feature: HIJSMM301AMMQT.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatgcaggcatcaacactgttttcggcggagggaccaagctgaccgtcctaggtcagcccaaggctgccccctcggtcta

SEQ ID NO: 588637 - DNA, 497 bp, Homo sapiens
  misc_feature: HIJSMM301ENF64.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccc

SEQ ID NO: 588638 - DNA, 501 bp, Homo sapiens; identical to SEQ ID NO: 535746
  misc_feature: HIJSMM301DSINH.18.11.A11.1.454.light.4.raw

SEQ ID NO: 588639 - DNA, 501 bp, Homo sapiens; identical to SEQ ID NO: 535873
  misc_feature: HIJSMM301DS4GM.17.27.C05.1.454.light.4.raw

SEQ ID NO: 588640 - DNA, 486 bp, Homo sapiens; identical to SEQ ID NO: 535385
  misc_feature: HIJSMM301EKWDQ.19.71.G05.1.454.light.4.raw

SEQ ID NO: 588641 - DNA, 501 bp, Homo sapiens
  misc_feature: HIJSMM301CO2WB.40.42.D09.1.454.light.4.raw
tctagcgactcacgaccggtgctcgatttagacacatacgcagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatgggggtattcggcggagggaccaagctgaccgtctaggtcagcccaaggctgccccctggtcactctcg

SEQ ID NO: 588642 - DNA, 383 bp, Homo sapiens; identical to SEQ ID NO: 447524
  misc_feature: HIJSMM301EFZYX.41.26.C04.1.454.light.4.raw

SEQ ID NO: 588643 - DNA, 482 bp, Homo sapiens; identical to SEQ ID NO: 535920
  misc_feature: HIJSMM301D3R9G.19.71.G05.1.454.light.4.raw

SEQ ID NO: 588644 - DNA, 508 bp, Homo sapiens
  misc_feature: HIJSMM301DKTVV.51.45.E01.1.454.light.4.raw
  modified_base (507)..(507): a, c, t, g, unknown or other
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagacgccggcctccatctcctgcaggtctagtcagagcctcctccataatagtggattcttcttatttggattggtacgtgctgaagccgagggcagtctccacaactcctgatctatttgcgttctaatcgggcctccggggtccctgacaggttcagtggcagtggatcaggcacagtattttacatgaacaatcaacagtaggtggaggctggaggtatttttaggggtttacttactgcgtgcaaagtctgacaaactatcaccttcggccgaagggacacgacgtggagtattaacgaatgtggctgcaacnt

SEQ ID NO: 588645 - DNA, 494 bp, Homo sapiens
  misc_feature: HIJSMM301BG6OK.51.33.C11.1.454.light.4.raw
cgatcgtatacacgaccggtgctcgatttagagtgagctcgttgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtggttcggcgggggaccgaagctgaccgtcctcggtcagcccaaggctgccccctcggtcta

SEQ ID NO: 588646 - DNA, 513 bp, Homo sapiens; identical to SEQ ID NO: 535719
  misc_feature: HIJSMM301BGVWJ.17.33.C11.1.454.light.4.raw

SEQ ID NO: 588647 - DNA, 494 bp, Homo sapiens
  misc_feature: HIJSMM301B2XSX.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcat

SEQ ID NO: 588648 - DNA, 487 bp, Homo sapiens
  misc_feature: HIJSMM301AUGDG.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaaactgaccgtcctaggtcagcccaaggctgtccccccg

SEQ ID NO: 588649 - DNA, 488 bp, Homo sapiens; identical to SEQ ID NO: 537260
  misc_feature: HIJSMM301ANLMQ.47.70.G04.1.454.light.4.raw

SEQ ID NO: 588650 - DNA, 506 bp, Homo sapiens
  misc_feature: HIJSMM301BBPU6.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctcgccccccg

SEQ ID NO: 588651 - DNA, 495 bp, Homo sapiens; identical to SEQ ID NO: 535486
  misc_feature: HIJSMM301BKZ82.26.72.G06.1.454.light.4.raw

SEQ ID NO: 588652 - DNA, 493 bp, Homo sapiens
  misc_feature: HIJSMM301EB5YC.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggcccatcactgggctccaggctgaggatgaggctgactattactgccagtcgtatgacagtggcctaagtaacatcgtcttcggaactggaccaaggtcaccgtccg

SEQ ID NO: 588653 - DNA, 489 bp, Homo sapiens
  misc_feature: HIJSMM301C2B1M.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtggacatcaagcgaactgtggctgcaccatct

SEQ ID NO: 588654 - DNA, 500 bp, Homo sapiens
  misc_feature: HIJSMM301DWEWN.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattataacttcgtggacgttcggtccaagggaccaaggtaggagtatacagacgaaactagtgg

SEQ ID NO: 588655 - DNA, 483 bp, Homo sapiens
  misc_feature: HIJSMM301CHSHL.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcagtctgttggagaaagatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgttacccccccacgttccggcggaggaccacagtcagatcaacgaactgtggctgcaccat

SEQ ID NO: 588656 - DNA, 501 bp, Homo sapiens; identical to SEQ ID NO: 555551
  misc_feature: HIJSMM301C4OWP.21.81.H04.1.454.light.4.raw

SEQ ID NO: 588657 - DNA, 494 bp, Homo sapiens; identical to SEQ ID NO: 552047
  misc_feature: HIJSMM301DX33C.26.72.G06.1.454.light.4.raw

SEQ ID NO: 588658 - DNA, 486 bp, Homo sapiens; identical to SEQ ID NO: 535043
  misc_feature: HIJSMM301BAO8O.46.35.D02.1.454.light.4.raw

SEQ ID NO: 588659 - DNA, 512 bp, Homo sapiens
  misc_feature: HIJSMM301A150S.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcaggcccaagg

SEQ ID NO: 588660 - DNA, 497 bp, Homo sapiens
  misc_feature: HIJSMM301B8G0N.19.71.G05.1.454.light.4.raw
  modified_base (488)..(488): a, c, t, g, unknown or other
tactctcgtgcacgaccggtgctcgatttagtgtcgtcgcaagagagaggggggaggtacaacaggcaggcaggggcagcaagatggtgttgtagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaacngtggctgca

SEQ ID NO: 588661 - DNA, 497 bp, Homo sapiens
  misc_feature: HIJSMM301ES11G.19.71.G05.1.454.light.4.raw
tactctcgtgcacgaccggtgctcgatttagtgtcgtcgcaagagagaggggggaggtacaacaggcaggcaggggcagcaagatggtgttgtagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 588662 - DNA, 524 bp, Homo sapiens
  misc_feature: HIJSMM301A1BBL.49.40.D07.1.454.light.4.raw
agtcgagagacacgaccggtgctcgatttagtgatagagcgtaacaacagaggggagcctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaaattgaccgtcctgggtcagcccaaggctgccccctcggtcactctgttccgccctcctctctctcg

SEQ ID NO: 588663 - DNA, 506 bp, Homo sapiens; identical to SEQ ID NO: 534969
  misc_feature: HIJSMM301DKL81.18.37.D04.1.454.light.4.raw

SEQ ID NO: 588664 - DNA, 481 bp, Homo sapiens; identical to SEQ ID NO: 538171
  misc_feature: HIJSMM301CW72U.15.8.A08.1.454.light.4.raw

SEQ ID NO: 588665 - DNA, 487 bp, Homo sapiens
  misc_feature: HIJSMM301C76B8.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacatatgatatttattctccagcgttcggccaggggaccaaggtggaagtcaagcgaactgtggctgcaccatctgt

SEQ ID NO: 588666 - DNA, 497 bp, Homo sapiens; identical to SEQ ID NO: 536376
  misc_feature: HIJSMM301BWP40.22.9.A09.1.454.light.4.raw

SEQ ID NO: 588667 - DNA, 486 bp, Homo sapiens
  misc_feature: HIJSMM301BQFDQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctatggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 588668 - DNA, 531 bp, Homo sapiens
  misc_feature: HIJSMM301CDCXQ.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcgaggtcgtatcttcttatcgttcgttacggaacgtcgggaaccgtaaggtccaccgttccgtaggtcaccgacccgaacggacccccaacccccactcgtaccta

SEQ ID NO: 588669 - DNA, 506 bp, Homo sapiens
  misc_feature: HIJSMM301CR96I.21.22.B11.1.454.light.4.raw
  modified_base (431)..(431): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacncaaacatgggatggacaatctgagcggttgggtgttcggcggaggaccaaactgaccgtcctagggtcagcccaa

SEQ ID NO: 588670 - DNA, 497 bp, Homo sapiens; identical to SEQ ID NO: 555392
  misc_feature: HIJSMM301BHLSY.43.71.G05.1.454.light.4.raw

SEQ ID NO: 588671 - DNA, 510 bp, Homo sapiens
  misc_feature: HIJSMM301C78YD.13.53.E09.1.454.light.4.raw
  modified_base (491)..(491): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtcacggacgaacggtaggaagtacaagacgaactagtggcgtgcaccaacnctgtcttctactcttccgt

SEQ ID NO: 588672 - DNA, 497 bp, Homo sapiens
  misc_feature: HIJSMM301BV2KP.27.78.H01.1.454.light.4.raw
  modified_base (433)..(433): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtnatcaccttcggccaagggacacgactggaagattaaacgaactgtggctgcaccatctgtcttt

SEQ ID NO: 588673 - DNA, 489 bp, Homo sapiens
  misc_feature: HIJSMM301CJHXA.22.65.F10.1.454.light.4.raw
  modified_base (466)..(466): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatcaccttcggccaaggacacgactggagataaacgaactntggctgcaccatctgtcttcatt

SEQ ID NO: 588674 - DNA, 519 bp, Homo sapiens
  misc_feature: HIJSMM301DKDUQ.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctccg

SEQ ID NO: 588675 - DNA, 470 bp, Homo sapiens
  misc_feature: HIJSMM301B2P4T.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcgccaggaccgaaggtaggaatacaaacgaactagt

SEQ ID NO: 588676 - DNA, 502 bp, Homo sapiens; identical to SEQ ID NO: 566939
  misc_feature: HIJSMM301C3BFP.22.21.B10.1.454.light.4.raw

SEQ ID NO: 588677 - DNA, 481 bp, Homo sapiens
  misc_feature: HIJSMM301B7X5B.49.33.C11.1.454.light.4.raw
agtcgagagacacgaccggtgctcgatttagagtgagctcgttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacagggtcccatcaaggttcagtggaagtggatctgggacagattttacttcaccatcagcagcctgcagcctgaagatattgcaacatattactgtcaacagtatgataatctcccactcactttcggcggaggaccaaggtggagatcaaacgaactgtggctgcaccta

SEQ ID NO: 588678 - DNA, 484 bp, Homo sapiens; identical to SEQ ID NO: 535211
  misc_feature: HIJSMM301BGXUI.47.46.E02.1.454.light.4.raw

SEQ ID NO: 588679 - DNA, 488 bp, Homo sapiens
  misc_feature: HIJSMM301D18SF.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtacaaacgaaacctagtggctgcaccatctgtcttc

SEQ ID NO: 588680 - DNA, 481 bp, Homo sapiens
  misc_feature: HIJSMM301AQPZ1.46.26.C04.1.454.light.4.raw
  modified_base (446)..(446): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntcactttcggcgagggaccaggtgagatcaacgaa

SEQ ID NO: 588681 - DNA, 487 bp, Homo sapiens; identical to SEQ ID NO: 537079
  misc_feature: HIJSMM301AV8ZB.14.55.E11.1.454.light.4.raw

SEQ ID NO: 588682 - DNA, 474 bp, Homo sapiens; identical to SEQ ID NO: 549812
  misc_feature: HIJSMM301D5V4P.11.76.G10.1.454.light.4.raw

SEQ ID NO: 588683 - DNA, 511 bp, Homo sapiens; identical to SEQ ID NO: 546062
  misc_feature: HIJSMM301B4XNS.5.58.F03.1.454.light.4.raw

SEQ ID NO: 588684 - DNA, 492 bp, Homo sapiens
  misc_feature: HIJSMM301EXK0W.46.67.G01.1.454.light.4.raw
actagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaaactgtggctgcaccatctgtcttcatcttcccgccat

SEQ ID NO: 588685 - DNA, 503 bp, Homo sapiens; identical to SEQ ID NO: 538973
  misc_feature: HIJSMM301AZRS0.5.86.H09.1.454.light.4.raw

SEQ ID NO: 588686 - DNA, 486 bp, Homo sapiens; identical to SEQ ID NO: 538754
  misc_feature: HIJSMM301E072Q.19.5.A05.1.454.light.4.raw

SEQ ID NO: 588687 - DNA, 444 bp, Homo sapiens; identical to SEQ ID NO: 535192
  misc_feature: HIJSMM301D4J39.5.9.A09.1.454.light.4.raw

SEQ ID NO: 588688 - DNA, 493 bp, Homo sapiens
  misc_feature: HIJSMM301C7T5M.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgagatttgcggtttattactgtcagcagtataataactggcctccacggtacacttttggccagggaccgaagctggagatcaaacgaactgtggctgcacatctgt

SEQ ID NO: 588689 - DNA, 496 bp, Homo sapiens; identical to SEQ ID NO: 537925
  misc_feature: HIJSMM301DKKDG.22.14.B03.1.454.light.4.raw

SEQ ID NO: 588690 - DNA, 482 bp, Homo sapiens
  misc_feature: HIJSMM301BLQOT.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcggaggagagtagaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggacc

SEQ ID NO: 588691 - DNA, 501 bp, Homo sapiens; identical to SEQ ID NO: 568268
  misc_feature: HIJSMM301DQ66Y.43.69.G03.1.454.light.4.raw

SEQ ID NO: 588692 - DNA, 447 bp, Homo sapiens; identical to SEQ ID NO: 535201
  misc_feature: HIJSMM301DJF2U.18.9.A09.1.454.light.4.raw

SEQ ID NO: 588693 - DNA, 479 bp, Homo sapiens; identical to SEQ ID NO: 535188
  misc_feature: HIJSMM301CT84K.10.74.G08.1.454.light.4.raw

SEQ ID NO: 588694 - DNA, 484 bp, Homo sapiens; identical to SEQ ID NO: 535400
  misc_feature: HIJSMM301BDCKO.46.26.C04.1.454.light.4.raw

SEQ ID NO: 588695 - DNA, 519 bp, Homo sapiens
  misc_feature: HIJSMM301CO8GT.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggacgcccatgctgcaagtcgggccagaggtcgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtgggcaggtcaggcccaaggcccaaccccactcgtcatttccg

SEQ ID NO: 588696 - DNA, 494 bp, Homo sapiens; identical to SEQ ID NO: 534992
  misc_feature: HIJSMM301CRU1V.9.1.A01.1.454.light.4.raw

SEQ ID NO: 588697 - DNA, 501 bp, Homo sapiens; identical to SEQ ID NO: 537545
  misc_feature: HIJSMM301DXKGT.49.69.G03.1.454.light.4.raw

SEQ ID NO: 588698 - DNA, 493 bp, Homo sapiens
  misc_feature: HIJSMM301BSTT3.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaaccca

SEQ ID NO: 588699 - DNA, 496 bp, Homo sapiens; identical to SEQ ID NO: 535541
  misc_feature: HIJSMM301BN31S.3.33.C11.1.454.light.4.raw

SEQ ID NO: 588700 - DNA, 514 bp, Homo sapiens
  misc_feature: HIJSMM301D76U2.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctcctaaccatctctgggctccagtttgaggacgagtctacttattactgcagttcctttaaattaggcgccactctcgtggttttcggcggaggcaccgaagtgaccgtcctcggtcagcccaaggctgccccctcggtcactctcg

SEQ ID NO: 588701 - DNA, 535 bp, Homo sapiens
  misc_feature: HIJSMM301A7Z19.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttcccagtccttctcgacggggtcccctcgaggttcagtggcagtggatcgtgggacactatttccaccctcaccatcaaatcgcctggaagctgaagatgcctgactaactttattactgtacatacagagttaccttacttttacctcaagtgatccaccgttccggaccgaaagggacaccgacgtaggagtaactttaaaaccg

SEQ ID NO: 588702 - DNA, 498 bp, Homo sapiens; identical to SEQ ID NO: 537020
  misc_feature: HIJSMM301AIZE8.26.26.C04.1.454.light.4.raw

SEQ ID NO: 588703 - DNA, 502 bp, Homo sapiens; identical to SEQ ID NO: 545036
  misc_feature: HIJSMM301DY476.15.57.F02.1.454.light.4.raw

SEQ ID NO: 588704 - DNA, 493 bp, Homo sapiens; identical to SEQ ID NO: 541365
  misc_feature: HIJSMM301EMT2I.4.27.C05.1.454.light.4.raw

SEQ ID NO: 588705 - DNA, 479 bp, Homo sapiens
  misc_feature: HIJSMM301DURWA.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtacccctggacttcggccaagggaccaaggtggaaatcaaacgaactagtggcgtgctaa

SEQ ID NO: 588706 - DNA, 514 bp, Homo sapiens; identical to SEQ ID NO: 572493
  misc_feature: HIJSMM301AVQSC.16.66.F11.1.454.light.4.raw

SEQ ID NO: 588707 - DNA, 495 bp, Homo sapiens
  misc_feature: HIJSMM301A3OUU.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatcctatttaatttcggtcggagggaccaaggtggagatcaaacgaactagtggctgcaccatctgtcttcatcttcccgccta

SEQ ID NO: 588708 - DNA, 444 bp, Homo sapiens; identical to SEQ ID NO: 534993
  misc_feature: HIJSMM301BPAEV.5.9.A09.1.454.light.4.raw

SEQ ID NO: 588709 - DNA, 496 bp, Homo sapiens
  misc_feature: HIJSMM301B99QB.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtggtcg

SEQ ID NO: 588710 - DNA, 489 bp, Homo sapiens; identical to SEQ ID NO: 536013
  misc_feature: HIJSMM301EYEYM.26.23.C01.1.454.light.4.raw

SEQ ID NO: 588711 - DNA, 486 bp, Homo sapiens
  misc_feature: HIJSMM301AUS87.43.54.E10.1.454.light.4.raw
tgtgagtagtcacgaccggtgctcgatttagatcgtagcagaacacacaaagggggatcaggactcctcagttcaccttctcacaatgaggctccctgctcagctcctggggctgctaatgctctgggtcccaggatccattggggatattgtgctgactcagtctccactctccctctccgtcacccttggacagtcggtgtccatctcctgcaggtctagtcacagcgtcctacacagtgatggaagaacctacttggattggtttcagcagaggccaggccaatctccaaggctcctaatttataaggtttctagtcgggactctggggtcccagacagattcagcggcagtgggtcaggcactgacttcacactgaaaatcagtagtgtggaggctgaggatgttgccatttattactgcatgcaagggacacactggccgtacacttttggccaggggaccaagctggagatcaaacgaaa

SEQ ID NO: 588712 - DNA, 503 bp, Homo sapiens
  misc_feature: HIJSMM301E4EUL.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacactttggtcgagggaccgaacgactggagatcaaacgaactagtggcgtgtcaccatctcgtt

SEQ ID NO: 588713 - DNA, 497 bp, Homo sapiens
  misc_feature: HIJSMM301EKABO.40.71.G05.1.454.light.4.raw
tctagcgactcacgaccggtgctcgatttagtgtcgtcgcaagagagagggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggctgagtgatgagtggatgttcggcggacgggaccaaactgaccgtctaggt

SEQ ID NO: 588714 - DNA, 503 bp, Homo sapiens; identical to SEQ ID NO: 547049
  misc_feature: HIJSMM301DSBTO.18.59.F04.1.454.light.4.raw

SEQ ID NO: 588715 - DNA, 517 bp, Homo sapiens; identical to SEQ ID NO: 537838
  misc_feature: HIJSMM301CDA6S.7.86.H09.1.454.light.4.raw

SEQ ID NO: 588716 - DNA, 456 bp, Homo sapiens
  misc_feature: HIJSMM301B79VW.19.86.H09.1.454.light.4.raw
tactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 588717 - DNA, 520 bp, Homo sapiens
  misc_feature: HIJSMM301EJOPU.9.38.D05.1.454.light.4.raw
tgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaactcttgctttatgatgtcagttatcggccctcaggagtttctgatcgcttctctggctccaagtctggcaccacggcctccctgaccatctctgggtctccaggctgaggacgaggctgattatttctgcagctcaaaagaagtagccctctcgtggttttcggcgggggaccaaggtgacgtcctaagtcagccaaggctgccccctcggtcactctgttcccaccctcctcacg

SEQ ID NO: 588718 - DNA, 485 bp, Homo sapiens
  misc_feature: HIJSMM301D9B2X.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattaactggactccaggctgacgacgaagctgattattactgctcagcatgggacaccggcctcagtgcgtgggttttcggcggagggaccaagctgaccgtcctaggtcagacccg

SEQ ID NO: 588719 - DNA, 447 bp, Homo sapiens; identical to SEQ ID NO: 535201
  misc_feature: HIJSMM301DT5M5.18.9.A09.1.454.light.4.raw

SEQ ID NO: 588720 - DNA, 521 bp, Homo sapiens; identical to SEQ ID NO: 539470
  misc_feature: HIJSMM301BREH6.27.23.C01.1.454.light.4.raw

SEQ ID NO: 588721 - DNA, 485 bp, Homo sapiens
  misc_feature: HIJSMM301EIBO5.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcgccctgggaccaaagtaggatatcaaacgaactgtgctgcaccatctgtt

SEQ ID NO: 588722 - DNA, 492 bp, Homo sapiens
  misc_feature: HIJSMM301C50D9.3.26.C04.1.454.light.4.raw
agacgcactccacgaccggtgctcgatttagtctagcgactttgggtttggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtctccatcacttgccgggccagtcagagtattagtcgctggttggcctggtatcagcagaaaccagggaaagcccctaagctcctgatctatcaggcgtctagtttacaaagtggggtcccatcaaggttcagcggcagtggatctgggacagaattcactctcaccatcagcagcctgcagcctgatgattttgcaacttattactgccaacagtataatacttattggacgttcggccaagggaccaaggtggaaatcaaacgaactgtggctgcaccatctgtcttcta

SEQ ID NO: 588723 - DNA, 489 bp, Homo sapiens; identical to SEQ ID NO: 535091
  misc_feature: HIJSMM301C4GTD.47.36.D03.1.454.light.4.raw

SEQ ID NO: 588724 - DNA, 494 bp, Homo sapiens
  misc_feature: HIJSMM301BE83X.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatcaaacgaactagtgg

SEQ ID NO: 588725 - DNA, 502 bp, Homo sapiens
  misc_feature: HIJSMM301C9X9V.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactccg

SEQ ID NO: 588726 - DNA, 495 bp, Homo sapiens
  misc_feature: HIJSMM301BGKHG.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcgggggaccaagctggagatcaaccgaactgtggctgcaccatctgtt

SEQ ID NO: 588727 - DNA, 517 bp, Homo sapiens
  misc_feature: HIJSMM301CV9N0.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagctaccctttatgtcttcgggactgtgaccaaggtcaccggtcctaggtccagcccaaggcccaaccccactgtcactctgttccca

SEQ ID NO: 588728 - DNA, 501 bp, Homo sapiens; identical to SEQ ID NO: 536142
  misc_feature: HIJSMM301CSZP6.15.1.A01.1.454.light.4.raw

SEQ ID NO: 588729 - DNA, 501 bp, Homo sapiens
  misc_feature: HIJSMM301EBPH3.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcggcggaggaccaaactgaccgtcctaggtcagcccaa

SEQ ID NO: 588730 - DNA, 469 bp, Homo sapiens
  misc_feature: HIJSMM301DUTI7.18.76.G10.1.454.light.4.raw
  modified_base (395)..(395): a, c, t, g, unknown or other
  modified_base (441)..(441): a, c, t, g, unknown or other
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacntactattgtcagcaatatgatttgctctccgagtgccattttcggngggggtaccaaggtggacatcaaacgaa

SEQ ID NO: 588731 - DNA, 494 bp, Homo sapiens
  misc_feature: HIJSMM301DTTJW.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctcacggtacacttttggccagggaccaagctggagatcaaacgaactgtggctgcaccatctgt

SEQ ID NO: 588732 - DNA, 508 bp, Homo sapiens
  misc_feature: HIJSMM301ARF2N.12.67.G01.1.454.light.4.raw
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaactcatgtatttttgatgtcactaatcggccctcaggggtttctgatcgcttctctggctccaagtctgactacacggcctccctgaccatctctgggctccaggctgaggacgaggctgattattattgcagctcatatacaagcagcagccacccttctttgtcttcggaagtgggaccaaggtcaccgtcctacgtcagcccaaggcccaacccca

SEQ ID NO: 588733 - DNA, 502 bp, Homo sapiens
  misc_feature: HIJSMM301CC1K9.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgtaactcgcttcttctggctccaagtctggcgacacggcctccctgaccatctctgggctccaggctgaagacgaggctgattattactgcagctcatatacaggcagcagcactcaggttttcggcggagggaccaaggctgaccgtcctaggtcagcccaaggctgccccctcgg

SEQ ID NO: 588734 - DNA, 500 bp, Homo sapiens; identical to SEQ ID NO: 562651
  misc_feature: HIJSMM301EMDSH.17.29.C07.1.454.light.4.raw

SEQ ID NO: 588735 - DNA, 485 bp, Homo sapiens; identical to SEQ ID NO: 536040
  misc_feature: HIJSMM301C5SY9.15.1.A01.1.454.light.4.raw

SEQ ID NO: 588736 - DNA, 473 bp, Homo sapiens; identical to SEQ ID NO: 535262
  misc_feature: HIJSMM301AMPAD.8.67.G01.1.454.light.4.raw

SEQ ID NO: 588737 - DNA, 479 bp, Homo sapiens; identical to SEQ ID NO: 570983
  misc_feature: HIJSMM301A76N4.11.76.G10.1.454.light.4.raw

SEQ ID NO: 588738 - DNA, 504 bp, Homo sapiens
  misc_feature: HIJSMM301EKKGO.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttcacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcta

SEQ ID NO: 588739 - DNA, 483 bp, Homo sapiens
  misc_feature: HIJSMM301C3MBS.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagtattttgctaacttactattgtcaacaggctaacagtttcccgctccaccgttcggcgggggaccgaaggtggagatacaaacgaactgtggctgcacc

SEQ ID NO: 588740 - DNA, 497 bp, Homo sapiens
  misc_feature: HIJSMM301APE4X.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggggaccaagctgaccgtcctaggtcagcccaaggctgccccctcggtcactctcgttccaccctcctcgagtgcgtct

SEQ ID NO: 588741 - DNA, 501 bp, Homo sapiens
  misc_feature: HIJSMM301AMR4N.22.15.B04.1.454.light.4.raw
acatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctc

SEQ ID NO: 588742 - DNA, 500 bp, Homo sapiens
  misc_feature: HIJSMM301B9NUT.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtagggagagtacaaacgaactagtgg

SEQ ID NO: 588743 - DNA, 505 bp, Homo sapiens
  misc_feature: HIJSMM301C2KDF.9.28.C06.1.454.light.4.raw
tgatacgtctcacgaccggtgctcgatttagagctcacgtattgggtttgggggggaagcctgagaacacttagccttcatgagtgtcccccaccatggcctggaggatgcttctcctcggactccttgcttatggatcaggagtggattctcagactgtggtgacccaggagccatcgttctcagtgtcccctggagggacagtcacactcacttgtggcttgagctctggctcagtctctacttttactaccccactggtaccagcagaccccaggccaggctccacgtatgatcatctacagcacaaacactcgctcttctggggtccctgatcgcttctctggctccatccttgggaacaagctcgccctcaccatcgacgggggcccaggcagatgatgaatctgattattactgtgttctatatatggatcgtggcatttggattgttcggcggagggaccaagttgaccgtctaggtcagcccaaggctcgccccccg

SEQ ID NO: 588744 - DNA, 491 bp, Homo sapiens; identical to SEQ ID NO: 535294
  misc_feature: HIJSMM301C6CKR.16.68.G02.1.454.light.4.raw

SEQ ID NO: 588745 - DNA, 493 bp, Homo sapiens
  misc_feature: HIJSMM301B13BS.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatacaacgaactgtggctgcaccatctgt

SEQ ID NO: 588746 - DNA, 492 bp, Homo sapiens; identical to SEQ ID NO: 557028
  misc_feature: HIJSMM301DXKVI.51.6.A06.1.454.light.4.raw

SEQ ID NO: 588747 - DNA, 459 bp, Homo sapiens; identical to SEQ ID NO: 541801
  misc_feature: HIJSMM301CJJQW.22.28.C06.1.454.light.4.raw

SEQ ID NO: 588748 - DNA, 521 bp, Homo sapiens
  misc_feature: HIJSMM301BPXGN.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctggttcggcggagggaccaagctgaccgtcctaggtcagcccaaggctcgccccctggtccactctcgttcccgccctcctcacg

SEQ ID NO: 588749 - DNA, 491 bp, Homo sapiens
  misc_feature: HIJSMM301DHAHZ.17.49.E05.1.454.light.4.raw
cgtagactagcacgaccggtgctcgatttagagcgactagcaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcagtttattactgtcagcaatataatgactggcctccgctcactttcggcggagggaccaaggtggagatcaaacgaactgtggctggcacca

SEQ ID NO: 588750 - DNA, 466 bp, Homo sapiens
  misc_feature: HIJSMM301AWBR9.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccgagggtggagatcagacgaactgtggctgcaccatctgtcttcatcttcccgcatctagaagtatagtct

SEQ ID NO: 588751 - DNA, 483 bp, Homo sapiens
  misc_feature: HIJSMM301BDVUD.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttatactgtcagcagtatcatgactggccgctcaccttcggccaagggacacgactggagattaaacgaactgtggctgcaccat

SEQ ID NO: 588752 - DNA, 479 bp, Homo sapiens; identical to SEQ ID NO: 558912
  misc_feature: HIJSMM301A71C9.40.23.C01.1.454.light.4.raw

SEQ ID NO: 588753 - DNA, 491 bp, Homo sapiens
  misc_feature: HIJSMM301ECAZY.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgacccatctctgggctccaggctgaggacgagggtgattattactgcagctcatatagaagtggcagcactctcgtattcggcggtgggaccaagctgaccgtcctaggtcagccc

SEQ ID NO: 588754 - DNA, 480 bp, Homo sapiens
  misc_feature: HIJSMM301A344O.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtaggaaatcaaacgaactagtggctgcaccat

SEQ ID NO: 588755 - DNA, 483 bp, Homo sapiens
  misc_feature: HIJSMM301DYXJS.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtaggaaatacaaacgaactagtgg

SEQ ID NO: 588756 - DNA, 491 bp, Homo sapiens; identical to SEQ ID NO: 535194
  misc_feature: HIJSMM301A0J17.26.78.H01.1.454.light.4.raw

SEQ ID NO: 588757 - DNA, 511 bp, Homo sapiens
  misc_feature: HIJSMM301BP4A4.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttatactgtcagcaatattatggtactcctccgtggacgttcggccgaaggaccaaggtaggaaatacaaacgaactgtggctgccaccatcttcg

SEQ ID NO: 588758 - DNA, 502 bp, Homo sapiens
  misc_feature: HIJSMM301DO5M8.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaaatatgctcggtggttccagcagaagccaggccaggccccagtactggtgatttataaagacattgagcggccctcagggatccctgagcgattctcgggctccaactctgggaacacggccactctgaccatcagtagggtcgaagccggggatgaggccgactattactgtcaggtgtgggatagtagtcgtgagcatgtggtattcgggcggagggaccaaaactggaccgtcctaggtcagcccaagggctgccccctggt

SEQ ID NO: 588759 - DNA, 485 bp, Homo sapiens
  misc_feature: HIJSMM301CCY1D.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcgagttcactctcaccatcagcagcctgcagtctgaagattttgcagtttattactgtcagcactctaatgactggcccctgtacacttttggcccgggaccaaggtggagatcaaacgaactgtggctgcaccatctgtt

SEQ ID NO: 588760 - DNA, 506 bp, Homo sapiens
  misc_feature: HIJSMM301DHHB4.48.14.B03.1.454.light.4.raw
agtatacatacacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgacccatctctgggctccaggctgaggacgaggctgattattactgcacctcatatacaagcagcagcactctcgtggtattcggcggagggaccaaggctgaccgtcctaggtcagcccaaggctgccccctcggt

SEQ ID NO: 588761 - DNA, 486 bp, Homo sapiens; identical to SEQ ID NO: 535043
  misc_feature: HIJSMM301DC4G9.46.35.D02.1.454.light.4.raw

SEQ ID NO: 588762 - DNA, 484 bp, Homo sapiens
  misc_feature: HIJSMM301D1HU1.48.73.G07.1.454.light.4.raw
agtatacatacacgaccggtgctcgatttagctctacgctcagggcacgaccggtgctcgatttagagctcacgtattgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggac

SEQ ID NO: 588763 - DNA, 511 bp, Homo sapiens
  misc_feature: HIJSMM301B9J55.40.23.C01.1.454.light.4.raw
tctagcgactcacgaccggtgctcgatttagtacacgtgattagggattggggggggagggaactgctcagttaggacccacgagggaaccatggaagccccagctcagcttctcttcctcctgctactctggctcccagataccaccggagaaattgtgttgacacagtctccagccaccctgtctttgtctccaggggaaagagccaccctctccttcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcgggagggaccaaggtggagatacaaacgaactgtggctgcaccatctgtcttcatcttccccg

SEQ ID NO: 588764 - DNA, 522 bp, Homo sapiens
  misc_feature: HIJSMM301CQH8Y.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaaggtacgaaacgaacgtagtggcgtgcgaccactctcgtcttctatcttccgtccctact

SEQ ID NO: 588765 - DNA, 383 bp, Homo sapiens; identical to SEQ ID NO: 584068
  misc_feature: HIJSMM301AG9CY.41.38.D05.1.454.light.4.raw

SEQ ID NO: 588766 - DNA, 497 bp, Homo sapiens
  misc_feature: HIJSMM301B8J33.3.78.H01.1.454.light.4.raw
agacgcactccacgaccggtgctcgatttagtgtgagtagtttgggtttgggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagttttattactgtcagcagcgtagcaactggctgatcaccttcggccaagggacacgactggagattaaacgaactgtggctgcaccatctgtcttcta

SEQ ID NO: 588767 - DNA, 494 bp, Homo sapiens
  misc_feature: HIJSMM301BQJCX.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaacccactgtcactctcg

SEQ ID NO: 588768 - DNA, 504 bp, Homo sapiens; identical to SEQ ID NO: 540636
  misc_feature: HIJSMM301CYMM8.19.67.G01.1.454.light.4.raw

SEQ ID NO: 588769 - DNA, 498 bp, Homo sapiens; identical to SEQ ID NO: 537020
  misc_feature: HIJSMM301COO3I.26.26.C04.1.454.light.4.raw

SEQ ID NO: 588770 - DNA, 487 bp, Homo sapiens; identical to SEQ ID NO: 543166
  misc_feature: HIJSMM301CGKH6.5.23.C01.1.454.light.4.raw

SEQ ID NO: 588771 - DNA, 484 bp, Homo sapiens; identical to SEQ ID NO: 537878
  misc_feature: HIJSMM301BKOU0.17.34.D01.1.454.light.4.raw

SEQ ID NO: 588772 - DNA, 489 bp, Homo sapiens; identical to SEQ ID NO: 535139
  misc_feature: HIJSMM301DX0K6.14.55.E11.1.454.light.4.raw

SEQ ID NO: 588773 - DNA, 496 bp, Homo sapiens
  misc_feature: HIJSMM301CQ51T.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctgcccccg

SEQ ID NO: 588774 - DNA, 491 bp, Homo sapiens; identical to SEQ ID NO: 546499
  misc_feature: HIJSMM301DSO39.48.35.D02.1.454.light.4.raw

SEQ ID NO: 588775 - DNA, 513 bp, Homo sapiens; identical to SEQ ID NO: 541387
  misc_feature: HIJSMM301BXTHJ.17.33.C11.1.454.light.4.raw

SEQ ID NO: 588776 - DNA, 499 bp, Homo sapiens
  misc_feature: HIJSMM301AN75H.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctcgaccgtctaggtcacgcccaggctccg

SEQ ID NO: 588777 - DNA, 478 bp, Homo sapiens; identical to SEQ ID NO: 552745
  misc_feature: HIJSMM301CUGB3.13.76.G10.1.454.light.4.raw

SEQ ID NO: 588778 - DNA, 494 bp, Homo sapiens
  misc_feature: HIJSMM301EUKMT.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggaggatcaaacgaactgtggctgcaccatctgtcttcat

SEQ ID NO: 588779 - DNA, 509 bp, Homo sapiens
  misc_feature: HIJSMM301A2F5A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaatacaaaacgaactagtggctgcaccatctgtcttctatcttccccg

SEQ ID NO: 588780 - DNA, 480 bp, Homo sapiens; identical to SEQ ID NO: 535630
  misc_feature: HIJSMM301AVZYQ.40.59.F04.1.454.light.4.raw

SEQ ID NO: 588781 - DNA, 500 bp, Homo sapiens; identical to SEQ ID NO: 535310
  misc_feature: HIJSMM301DOQ37.47.66.F11.1.454.light.4.raw

SEQ ID NO: 588782 - DNA, 510 bp, Homo sapiens
  misc_feature: HIJSMM301EH23O.48.54.E10.1.454.light.4.raw
agtatacatacacgaccggtgctcgatttagatcgtagcagaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcact

SEQ ID NO: 588783 - DNA, 485 bp, Homo sapiens; identical to SEQ ID NO: 535985
  misc_feature: HIJSMM301BL2YC.15.1.A01.1.454.light.4.raw

SEQ ID NO: 588784 - DNA, 498 bp, Homo sapiens
  misc_feature: HIJSMM301C6CCW.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccca

SEQ ID NO: 588785 - DNA, 484 bp, Homo sapiens; identical to SEQ ID NO: 535400
  misc_feature: HIJSMM301DHW87.46.26.C04.1.454.light.4.raw

SEQ ID NO: 588786 - DNA, 505 bp, Homo sapiens
  misc_feature: HIJSMM301A8U8H.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggttgggtgttcggcgggagggaccaaactgaccgtcctaggtcagccccaa

SEQ ID NO: 588787 - DNA, 469 bp, Homo sapiens
  misc_feature: HIJSMM301EH7TH.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcacctttcggccaaggggacacgactggagaattaaacgaa

SEQ ID NO: 588788 - DNA, 479 bp, Homo sapiens
  misc_feature: HIJSMM301CSZKG.43.12.B01.1.454.light.4.raw
tgtgagtagtcacgaccggtgctcgatttagtagtgtagattccgcgggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccactttactattgtcaacaggctgacagtttccccttcaccttcggccaagggacacgactggacattaaacgaactgtgctgcacc

SEQ ID NO: 588789 - DNA, 489 bp, Homo sapiens; identical to SEQ ID NO: 548587
  misc_feature: HIJSMM301BZBE1.22.65.F10.1.454.light.4.raw

SEQ ID NO: 588790 - DNA, 484 bp, Homo sapiens; identical to SEQ ID NO: 535400
  misc_feature: HIJSMM301BWWMG.46.26.C04.1.454.light.4.raw

SEQ ID NO: 588791 - DNA, 498 bp, Homo sapiens
  misc_feature: HIJSMM301AZW1V.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatacaaacgaactgtggctgcacca

SEQ ID NO: 588792 - DNA, 488 bp, Homo sapiens
  misc_feature: HIJSMM301CO62M.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattggctgttcggcggcggaccaagttgaccgtctacg

SEQ ID NO: 588793 - DNA, 513 bp, Homo sapiens; identical to SEQ ID NO: 545752
  misc_feature: HIJSMM301EDLOX.17.33.C11.1.454.light.4.raw

SEQ ID NO: 588794 - DNA, 495 bp, Homo sapiens; identical to SEQ ID NO: 538277
  misc_feature: HIJSMM301C80M6.16.53.E09.1.454.light.4.raw

SEQ ID NO: 588795 - DNA, 464 bp, Homo sapiens; identical to SEQ ID NO: 536640
  misc_feature: HIJSMM301BL8WD.26.78.H01.1.454.light.4.raw

SEQ ID NO: 588796 - DNA, 514 bp, Homo sapiens; identical to SEQ ID NO: 546238
  misc_feature: HIJSMM301BCXE3.47.85.H08.1.454.light.4.raw

SEQ ID NO: 588797 - DNA, 522 bp, Homo sapiens
  misc_feature: HIJSMM301APVNY.12.71.G05.1.454.light.4.raw
  modified_base (518)..(518): a, c, t, g, unknown or other
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtggttcggcggcgggaccaaagtgaccgtcctaagtcagccaacggctgccccctcggtcactctgttcccnccct

SEQ ID NO: 588798 - DNA, 489 bp, Homo sapiens; identical to SEQ ID NO: 535139
  misc_feature: HIJSMM301A8XEO.14.55.E11.1.454.light.4.raw

SEQ ID NO: 588799 - DNA, 501 bp, Homo sapiens; identical to SEQ ID NO: 560931
  misc_feature: HIJSMM301DF4QC.43.34.D01.1.454.light.4.raw

SEQ ID NO: 588800 - DNA, 488 bp, Homo sapiens
  misc_feature: HIJSMM301EJQFM.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttaattggacgttcggtccaggggaccgaaggtacgaaatagagacgaactagtggctgcaccat

SEQ ID NO: 588801 - DNA, 494 bp, Homo sapiens; identical to SEQ ID NO: 534994
  misc_feature: HIJSMM301EAE7W.27.78.H01.1.454.light.4.raw

SEQ ID NO: 588802 - DNA, 514 bp, Homo sapiens
  misc_feature: HIJSMM301EWQ1K.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactcgtcactcttcg

SEQ ID NO: 588803 - DNA, 486 bp, Homo sapiens
  misc_feature: HIJSMM301BDV0P.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtcagcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcgcggagggaccaaggtggagatcaaacgaactgtggctgcaccatctgtcttcattcc

SEQ ID NO: 588804 - DNA, 444 bp, Homo sapiens
  misc_feature: HIJSMM301BJCRW.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctgttcccgccctcctccgtgttgat

SEQ ID NO: 588805 - DNA, 504 bp, Homo sapiens
  misc_feature: HIJSMM301AOFOY.51.83.H06.1.454.light.4.raw
cgatcgtatacacgaccggtgctcgatttagatcacgtgcgtcgcggggggaactgctcagttaggacccagagggaaccatggaagccccagctcagcttctcttcctcctgctactctgcctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtaggaaatacaaacgaactagtggctgcaccatctgtcttcatcttccccg

SEQ ID NO: 588806 - DNA, 499 bp, Homo sapiens
  misc_feature: HIJSMM301C0EZ2.51.33.C11.1.454.light.4.raw
cgatcgtatacacgaccggtgctcgatttagagtgagctcgttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactcctggggacacagccactctgaccatccgcgggacccaggctgtggatgaggctggactattactgtcaggcgtgggacagggaggctgcgattttcggcggagggaccagtctgaccgtcctaggtcagcccaaggctgccccctcggtcactcc

SEQ ID NO: 588807 - DNA, 485 bp, Homo sapiens
  misc_feature: HIJSMM301A2UT7.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcctaccctcctcgctacgtaga

SEQ ID NO: 588808 - DNA, 480 bp, Homo sapiens; identical to SEQ ID NO: 557442
  misc_feature: HIJSMM301C0NQE.8.53.E09.1.454.light.4.raw

SEQ ID NO: 588809 - DNA, 500 bp, Homo sapiens
  misc_feature: HIJSMM301CKC36.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctgaagtattttgctagtttattacttgtcagcagtatgatacctggcctccgtactacgttttcggccgggggaccaagctaggaaatcaagcgaactggtggctgcaccatctgtcttcatt

SEQ ID NO: 588810 - DNA, 501 bp, Homo sapiens; identical to SEQ ID NO: 536867
  misc_feature: HIJSMM301BL9Q9.5.86.H09.1.454.light.4.raw

SEQ ID NO: 588811 - DNA, 510 bp, Homo sapiens
  misc_feature: HIJSMM301EZCP0.53.44.D11.1.454.light.4.raw
cgcgtatacacacgaccggtgctcgatttagcgcagtacgaaggggctgggcctaaggaagcagcactggtggtgcctcagccatggcctggaccgttctcctcctcggcctcctctctcactgcacaggctctgtgacctcctatgtgctggctcagccaacctcggtgtcggtggccccaggacagacggccaccattacctgtgggggagaggacattggaagcaaaagagtgcactggtaccagcagaagtcaggccaggcccctgtgctggtcatctatggtggaagaaaccggccctcatggatccctgagcgattgtctggctccaactctggcaatatggccaccctaatgatcagaagggtcgaagccggggatgaggccgactattactgtcaggtgtgggatagtagtagtgatcggaattgggtgttcggcggagggaccaagctgaccgtcctaggtcagcccaaggctgccccctcggtcactctgttcccaccct

SEQ ID NO: 588812 - DNA, 440 bp, Homo sapiens
  misc_feature: HIJSMM301EOLUT.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgatctctcg

SEQ ID NO: 588813 - DNA, 499 bp, Homo sapiens; identical to SEQ ID NO: 536578
  misc_feature: HIJSMM301DNR96.22.27.C05.1.454.light.4.raw

SEQ ID NO: 588814 - DNA, 500 bp, Homo sapiens
  misc_feature: HIJSMM301ASE9R.5.24.C02.1.454.light.4.raw
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctg

SEQ ID NO: 588815 - DNA, 469 bp, Homo sapiens
  misc_feature: HIJSMM301C6Z11.41.81.H04.1.454.light.4.raw
tctatactatcacgaccggtgctcgatttagtagtgtagattcgcgggggcaggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtggggtcccatcaaggttcagcggcagtggatctggcacagatttcactctcaccatcagcagcctgcagcctgaagattttgcaacttattactgtctacaagattacaattaccctcggacttttggccaggggaccaggctggagatcaaacgaa

SEQ ID NO: 588816 - DNA, 512 bp, Homo sapiens; identical to SEQ ID NO: 562621
  misc_feature: HIJSMM301EQJBV.7.34.D01.1.454.light.4.raw

SEQ ID NO: 588817 - DNA, 485 bp, Homo sapiens; identical to SEQ ID NO: 541539
  misc_feature: HIJSMM301DERW1.3.10.A10.1.454.light.4.raw

SEQ ID NO: 588818 - DNA, 496 bp, Homo sapiens
  misc_feature: HIJSMM301DJB67.51.57.F02.1.454.light.4.raw
cgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 588819 - DNA, 516 bp, Homo sapiens
  misc_feature: HIJSMM301EGDJM.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactttgttcccacctcctcgta

SEQ ID NO: 588820 - DNA, 479 bp, Homo sapiens; identical to SEQ ID NO: 542895
  misc_feature: HIJSMM301EAA6P.40.59.F04.1.454.light.4.raw

SEQ ID NO: 588821 - DNA, 489 bp, Homo sapiens
  misc_feature: HIJSMM301D4VFU.22.86.H09.1.454.light.4.raw
acatacgcgtcacgaccggtgctcgatttagtgctatagacttgggtttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcattttgcaggcgcctacacttggtgttcggcggagggaccaagctgaccgtcctaggtcagcccaa

SEQ ID NO: 588822 - DNA, 500 bp, Homo sapiens
  misc_feature: HIJSMM301CW1NP.52.75.G09.1.454.light.4.raw
cgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcattggaaccagcagtgacattggtcgttataactatgtctcctggtaccgacaacaccccggcaaagcccccaaactcatgatttatgctgtcacttatcggcccgcagggatttctcatcgcttctctggctccaagtctggcaacacggcctccctcaccatctctgggctcctgactgaggacgaggctgattattactgcagctcatttacaagcaccaccactcctgtaatcttcggcggagggaccaagctgaccgtcctaggtcagcccaaggctgccccctcggt

SEQ ID NO: 588823 - DNA, 494 bp, Homo sapiens
  misc_feature: HIJSMM301EXR07.41.35.D02.1.454.light.4.raw
  modified_base (386)..(386): a, c, t, g, unknown or other
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggcntccaggcggaggacgaggctgattactactgcttctcatatgcagatactaagtcctgggtgttcggcggaggaccaaactgacgtctaggtcagccaggcctgcccc

SEQ ID NO: 588824 - DNA, 518 bp, Homo sapiens; identical to SEQ ID NO: 539372
  misc_feature: HIJSMM301DOL6L.7.86.H09.1.454.light.4.raw

SEQ ID NO: 588825 - DNA, 504 bp, Homo sapiens; identical to SEQ ID NO: 538940
  misc_feature: HIJSMM301BMNWO.2.35.D02.1.454.light.4.raw

SEQ ID NO: 588826 - DNA, 447 bp, Homo sapiens
  misc_feature: HIJSMM301DL4OK.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccaaggccaaccccactgtcactctcgttcccaccctcctccatactcgta

SEQ ID NO: 588827 - DNA, 481 bp, Homo sapiens; identical to SEQ ID NO: 535993
  misc_feature: HIJSMM301CPDDN.21.25.C03.1.454.light.4.raw

SEQ ID NO: 588828 - DNA, 491 bp, Homo sapiens; identical to SEQ ID NO: 536211
  misc_feature: HIJSMM301AGKU1.16.53.E09.1.454.light.4.raw

SEQ ID NO: 588829 - DNA, 477 bp, Homo sapiens
  misc_feature: HIJSMM301EOBZ3.48.68.G02.1.454.light.4.raw
agtatacatacacgaccggtgctcgatttagtcgatagtgaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccgaggctgaggatggaggctgattattactgctgctcatatgcaggcagctacactttggtgttcggcggagggaccaagctgactgtcct

SEQ ID NO: 588830 - DNA, 490 bp, Homo sapiens; identical to SEQ ID NO: 544504
  misc_feature: HIJSMM301CV0HW.15.74.G08.1.454.light.4.raw

SEQ ID NO: 588831 - DNA, 472 bp, Homo sapiens; identical to SEQ ID NO: 535898
  misc_feature: HIJSMM301B193A.15.8.A08.1.454.light.4.raw

SEQ ID NO: 588832 - DNA, 494 bp, Homo sapiens; identical to SEQ ID NO: 535478
  misc_feature: HIJSMM301CO61Z.10.79.H02.1.454.light.4.raw

SEQ ID NO: 588833 - DNA, 518 bp, Homo sapiens; identical to SEQ ID NO: 539372
  misc_feature: HIJSMM301B85GT.7.86.H09.1.454.light.4.raw

SEQ ID NO: 588834 - DNA, 507 bp, Homo sapiens
  misc_feature: HIJSMM301DWBOY.43.72.G06.1.454.light.4.raw
tgtgagtagtcacgaccggtgctcgatttagctacgactgcaagggaaaggggctgggcctcaggaagcagcatcgggggtgccgcagccatggcctggaccgctctccttctgagcctccttgctcactttacaggttctgtggcctcctatgagctgactcagccactctcagtgtcagtggccctgggacaggcggccaagataacctgtgggggaaacaacattggagataagagtgtccactggtatcaccagaagccaggccaggcccctgtgttggtcatctatagagataccagccggccctctgggatccctgagcgattctctggctccaactcggggaacacggccaccctgaccatcagcagagcccaagccgggatgagggtgactattactgtcaggtgtgggacagcaacactgtgatttcggcggaggggccaagttgaccgtgctaggtcagcccaaggctgccccctcggtcactctcgttcccaccct

SEQ ID NO: 588835 - DNA, 514 bp, Homo sapiens
  misc_feature: HIJSMM301ERXG4.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtggggataatggtggtgatcatccggtcttcggcggagggaccaagttgaccgtcctaagtcagcccaaggctgccccctcggtcactctgttcccaccctcctcta

SEQ ID NO: 588836 - DNA, 493 bp, Homo sapiens
  misc_feature: HIJSMM301AOPL0.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggaggatcaaacgaactgtggctgcaccatctgtcttcatcttcccgccta

SEQ ID NO: 588837 - DNA, 479 bp, Homo sapiens
  misc_feature: HIJSMM301BYYHW.49.49.E05.1.454.light.4.raw
agtcgagagacacgaccggtgctcgatttagagcgactagcaacacacaaaggggtctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcctgcactgggagcagctccaacatcggggcaggttatgatgtacactggtatcagcagcttcccggaacagcccccaaactcctcatctatgatgacattaagcggccctcggggtccctgaccgattctctggctccaagtctggcaccgcagcctccctggccatcactgggctccaggctgaggatgaggctgattattactgccagacctatgacaccagcctgactgtcgtggtcttcggcggagggaccg

SEQ ID NO: 588838 - DNA, 490 bp, Homo sapiens; identical to SEQ ID NO: 536481
  misc_feature: HIJSMM301B8VYY.13.46.E02.1.454.light.4.raw

SEQ ID NO: 588839 - DNA, 489 bp, Homo sapiens; identical to SEQ ID NO: 549568
  misc_feature: HIJSMM301EHQVZ.43.33.C11.1.454.light.4.raw

SEQ ID NO: 588840 - DNA, 493 bp, Homo sapiens; identical to SEQ ID NO: 539702
  misc_feature: HIJSMM301DYGT3.27.78.H01.1.454.light.4.raw

SEQ ID NO: 588841 - DNA, 485 bp, Homo sapiens; identical to SEQ ID NO: 538956
  misc_feature: HIJSMM301AGHMU.40.69.G03.1.454.light.4.raw

SEQ ID NO: 588842 - DNA, 485 bp, Homo sapiens; identical to SEQ ID NO: 535606
  misc_feature: HIJSMM301A4QAY.47.46.E02.1.454.light.4.raw

SEQ ID NO: 588843 - DNA, 502 bp, Homo sapiens
  misc_feature: HIJSMM301EV480.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgattacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccgcctcctcta

SEQ ID NO: 588844 - DNA, 494 bp, Homo sapiens; identical to SEQ ID NO: 550130
  misc_feature: HIJSMM301B9C8L.12.38.D05.1.454.light.4.raw

SEQ ID NO: 588845 - DNA, 490 bp, Homo sapiens; identical to SEQ ID NO: 541567
  misc_feature: HIJSMM301BQVT7.22.65.F10.1.454.light.4.raw

SEQ ID NO: 588846 - DNA, 504 bp, Homo sapiens
  misc_feature: HIJSMM301CNYHE.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaaggctgaccgtcctaggtcagcccaaggctgccccctcggt

SEQ ID NO: 588847 - DNA, 460 bp, Homo sapiens; identical to SEQ ID NO: 537107
  misc_feature: HIJSMM301AIEHR.22.28.C06.1.454.light.4.raw

SEQ ID NO: 588848 - DNA, 474 bp, Homo sapiens
  misc_feature: HIJSMM301CQ4LO.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtaggaaatacaaacgaactgtgg

SEQ ID NO: 588849 - DNA, 494 bp, Homo sapiens; identical to SEQ ID NO: 534992
  misc_feature: HIJSMM301C333P.9.1.A01.1.454.light.4.raw

SEQ ID NO: 588850 - DNA, 497 bp, Homo sapiens; identical to SEQ ID NO: 534982
  misc_feature: HIJSMM301EXM9A.26.80.H03.1.454.light.4.raw

SEQ ID NO: 588851 - DNA, 495 bp, Homo sapiens; identical to SEQ ID NO: 535143
  misc_feature: HIJSMM301ATMG4.51.29.C07.1.454.light.4.raw

SEQ ID NO: 588852 - DNA, 493 bp, Homo sapiens
  misc_feature: HIJSMM301DO4BX.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatcaccttcggccaagggacacgactggagattaaacgaactgtggctgcaccatctgtcttcattcc

SEQ ID NO: 588853 - DNA, 460 bp, Homo sapiens; identical to SEQ ID NO: 536053
  misc_feature: HIJSMM301B37A5.22.28.C06.1.454.light.4.raw

SEQ ID NO: 588854 - DNA, 491 bp, Homo sapiens
  misc_feature: HIJSMM301AX4UJ.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaaagggaccaaggtggaaatcaagcgaactgtggctgcacca

SEQ ID NO: 588855 - DNA, 499 bp, Homo sapiens
  misc_feature: HIJSMM301DOMEW.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctgaagtattttgcggtttattactgtcagcagtataataactggcctccacggtactacttttggccaggggaccaagctggagatcaaacgaactgtggctgcaccatctgt

SEQ ID NO: 588856 - DNA, 452 bp, Homo sapiens
  misc_feature: HIJSMM301B9AD2.19.86.H09.1.454.light.4.raw
tactctcgtgcacgaccggtgctcgatttagtgctatagacttgggtttggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 588857 - DNA, 490 bp, Homo sapiens; identical to SEQ ID NO: 587852
  misc_feature: HIJSMM301CJCMU.10.77.G11.1.454.light.4.raw

SEQ ID NO: 588858 - DNA, 493 bp, Homo sapiens; identical to SEQ ID NO: 535745
  misc_feature: HIJSMM301EVDVU.47.78.H01.1.454.light.4.raw

SEQ ID NO: 588859 - DNA, 484 bp, Homo sapiens; identical to SEQ ID NO: 536393
  misc_feature: HIJSMM301BD8FF.4.41.D08.1.454.light.4.raw

SEQ ID NO: 588860 - DNA, 510 bp, Homo sapiens; identical to SEQ ID NO: 538614
  misc_feature: HIJSMM301C1G28.19.59.F04.1.454.light.4.raw

SEQ ID NO: 588861 - DNA, 491 bp, Homo sapiens; identical to SEQ ID NO: 563425
  misc_feature: HIJSMM301EFIYQ.43.82.H05.1.454.light.4.raw

SEQ ID NO: 588862 - DNA, 517 bp, Homo sapiens
  misc_feature: HIJSMM301DSVTV.43.23.C01.1.454.light.4.raw
  modified_base (473)..(473): a, c, t, g, unknown or other
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcgggcggagggaccaagctgaccgtcctgggtcngcccaaggctgccccctcggtcactctgttcccaccctcctcta

SEQ ID NO: 588863 - DNA, 444 bp, Homo sapiens; identical to SEQ ID NO: 535192
  misc_feature: HIJSMM301CP65A.5.9.A09.1.454.light.4.raw

SEQ ID NO: 588864 - DNA, 502 bp, Homo sapiens
  misc_feature: HIJSMM301CV5G2.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcgaccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggct

SEQ ID NO: 588865 - DNA, 489 bp, Homo sapiens
  misc_feature: HIJSMM301CO1K5.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgttggacgttcggccaagggaccaaggtggatatcagagaa

SEQ ID NO: 588866 - DNA, 505 bp, Homo sapiens; identical to SEQ ID NO: 538422
  misc_feature: HIJSMM301B61BZ.19.78.H01.1.454.light.4.raw

SEQ ID NO: 588867 - DNA, 494 bp, Homo sapiens
  misc_feature: HIJSMM301B9Y5K.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagtacagattcagcggcagtggcactgatgtcacactgacaatcagcagggtggaggctgaggatgttgggtttgttcctccatgcaaggtacacactggccttttggccaggggaccaaccgtggagatcaaatgaactgtggctgcaccatctgtctt

SEQ ID NO: 588868 - DNA, 500 bp, Homo sapiens
  misc_feature: HIJSMM301CE958.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacttcggtcggagggaccgagggtgggagagtacaaacgaactagtggcgtgcaccatctgtcttctatt

SEQ ID NO: 588869 - DNA, 488 bp, Homo sapiens; identical to SEQ ID NO: 535861
  misc_feature: HIJSMM301D1THS.14.55.E11.1.454.light.4.raw

SEQ ID NO: 588870 - DNA, 508 bp, Homo sapiens
  misc_feature: HIJSMM301CT5B7.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgtatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgtcccta

SEQ ID NO: 588871 - DNA, 495 bp, Homo sapiens; identical to SEQ ID NO: 539267
  misc_feature: HIJSMM301EBE7D.21.27.C05.1.454.light.4.raw

SEQ ID NO: 588872 - DNA, 513 bp, Homo sapiens; identical to SEQ ID NO: 535719
  misc_feature: HIJSMM301EDPZJ.17.33.C11.1.454.light.4.raw

SEQ ID NO: 588873 - DNA, 404 bp, Homo sapiens
  misc_feature: HIJSMM301D2IUM.4.35.D02.1.454.light.4.raw
agcactgtagcacgaccggtgctcgatttagcacacgatagttgggtttggggtttcatgagtgcatggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctcctacagtgct

SEQ ID NO: 588874 - DNA, 493 bp, Homo sapiens
  misc_feature: HIJSMM301C4P84.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatagaaagttattccttttacttcggccctgggaccaaagtggatatcaaacgaactgtggctgcaccat

SEQ ID NO: 588875 - DNA, 480 bp, Homo sapiens
  misc_feature: HIJSMM301EUVIT.40.86.H09.1.454.light.4.raw
tctagcgactcacgaccggtgctcgatttagtgctatagacttggtttggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaa

SEQ ID NO: 588876 - DNA, 485 bp, Homo sapiens
  misc_feature: HIJSMM301C12VQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggccaaggtggatatcagacgaa

SEQ ID NO: 588877 - DNA, 494 bp, Homo sapiens; identical to SEQ ID NO: 534992
  misc_feature: HIJSMM301CYS84.9.1.A01.1.454.light.4.raw

SEQ ID NO: 588878 - DNA, 466 bp, Homo sapiens; identical to SEQ ID NO: 552352
  misc_feature: HIJSMM301C13ZY.40.76.G10.1.454.light.4.raw

SEQ ID NO: 588879 - DNA, 482 bp, Homo sapiens
  misc_feature: HIJSMM301B8OV2.52.41.D08.1.454.light.4.raw
cgcagtacgacacgaccggtgctcgatttagtcacgcgagaaagggaaaggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagtagagggcacagcaactacgccatcgcatggcatcagcagcagccagagaagggccctcgatacttgatgatgttttatagtgatgggagtcacatcaagggggacgggatccctgctcgcttctcaggctccagctctgggactgggcgccacctcatcatctccagcctccagtctgaggatgaggctgattattactgtcagacctggggcactggcattcgggtcttcgggcggagggaccaaactgaccgtcctaggtcagcccaagg

SEQ ID NO: 588880 - DNA, 501 bp, Homo sapiens
  misc_feature: HIJSMM301ECCH9.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcgtccctcgggaccgaaagtaggagtttactagacgaactagtggctgcaccactctgtcttcta

SEQ ID NO: 588881 - DNA, 498 bp, Homo sapiens; identical to SEQ ID NO: 536173
  misc_feature: HIJSMM301BT5VH.12.86.H09.1.454.light.4.raw

SEQ ID NO: 588882 - DNA, 503 bp, Homo sapiens
  misc_feature: HIJSMM301BFWR8.43.3.A03.1.454.light.4.raw
tgtgagtagtcacgaccggtgctcgatttagagagcgtcacaggggctggtggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtcccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtcttggtcagcccaaggctgccccctcggtcactc

SEQ ID NO: 588883 - DNA, 508 bp, Homo sapiens
  misc_feature: HIJSMM301A7KL2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaatacaaacgaactagtggctgcaccatctgtcttctatcttccccg

SEQ ID NO: 588884 - DNA, 504 bp, Homo sapiens
  misc_feature: HIJSMM301CKRIP.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggaccaaatgaccgtcctagggtcagccccaa

SEQ ID NO: 588885 - DNA, 496 bp, Homo sapiens; identical to SEQ ID NO: 541857
  misc_feature: HIJSMM301D6MN6.3.31.C09.1.454.light.4.raw

SEQ ID NO: 588886 - DNA, 485 bp, Homo sapiens; identical to SEQ ID NO: 548974
  misc_feature: HIJSMM301ALDJC.48.77.G11.1.454.light.4.raw

SEQ ID NO: 588887 - DNA, 505 bp, Homo sapiens; identical to SEQ ID NO: 535503
  misc_feature: HIJSMM301BF3BM.8.28.C06.1.454.light.4.raw

SEQ ID NO: 588888 - DNA, 509 bp, Homo sapiens; identical to SEQ ID NO: 545002
  misc_feature: HIJSMM301EN3GM.14.7.A07.1.454.light.4.raw

SEQ ID NO: 588889 - DNA, 474 bp, Homo sapiens
  misc_feature: HIJSMM301EW10U.13.48.E04.1.454.light.4.raw
tcacgtactacacgaccggtgctcgatttagagagcgtcacagagagaagggggcaggagtcagacccactcaggacacagcatggacatgagggtccccactcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcggcagcctgcagcctgaagattttgcaacttattactgtctacaagatcacaattatcctgggacgttcggccaagggaccaaggtggaaagtcaaacgaa

SEQ ID NO: 588890 - DNA, 494 bp, Homo sapiens
  misc_feature: HIJSMM301AQ9XK.27.78.H01.1.454.light.4.raw
  modified_base (479)..(479): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacgaactagtggntgcaccatctgtctt

SEQ ID NO: 588891 - DNA, 493 bp, Homo sapiens; identical to SEQ ID NO: 536246
  misc_feature: HIJSMM301DIXAI.49.66.F11.1.454.light.4.raw

SEQ ID NO: 588892 - DNA, 498 bp, Homo sapiens; identical to SEQ ID NO: 581860
  misc_feature: HIJSMM301DJU04.53.38.D05.1.454.light.4.raw

SEQ ID NO: 588893 - DNA, 502 bp, Homo sapiens; identical to SEQ ID NO: 540196
  misc_feature: HIJSMM301E0SVS.40.45.E01.1.454.light.4.raw

SEQ ID NO: 588894 - DNA, 516 bp, Homo sapiens; identical to SEQ ID NO: 542547
  misc_feature: HIJSMM301A9NJ4.5.27.C05.1.454.light.4.raw

SEQ ID NO: 588895 - DNA, 516 bp, Homo sapiens
  misc_feature: HIJSMM301ESR5S.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggcccgtcgggaccaaaattagagatacaaacgaaactgtggctgcaccactctgtcttctatcttcccg

SEQ ID NO: 588896 - DNA, 489 bp, Homo sapiens
  misc_feature: HIJSMM301BSK32.10.53.E09.1.454.light.4.raw
  modified_base (479)..(479): a, c, t, g, unknown or other
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttatactgtcagcactattatacgtaccccattcacattccggccctgggaacccaaagtgganatcaaacgaa

SEQ ID NO: 588897 - DNA, 516 bp, Homo sapiens; identical to SEQ ID NO: 562329
  misc_feature: HIJSMM301CNBT0.5.27.C05.1.454.light.4.raw

SEQ ID NO: 588898 - DNA, 454 bp, Homo sapiens; identical to SEQ ID NO: 535005
  misc_feature: HIJSMM301AVZPS.19.86.H09.1.454.light.4.raw

SEQ ID NO: 588899 - DNA, 486 bp, Homo sapiens; identical to SEQ ID NO: 535043
  misc_feature: HIJSMM301DU34B.46.35.D02.1.454.light.4.raw

SEQ ID NO: 588900 - DNA, 492 bp, Homo sapiens
  misc_feature: HIJSMM301BH0QL.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacgaactgtggctgcaccatctgt

SEQ ID NO: 588901 - DNA, 515 bp, Homo sapiens; identical to SEQ ID NO: 553540
  misc_feature: HIJSMM301ENV2E.22.36.D03.1.454.light.4.raw

SEQ ID NO: 588902 - DNA, 484 bp, Homo sapiens
  misc_feature: HIJSMM301CW884.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcagctgaagatgtggcagcttattattgtcagcaatattatacttctcttccgatcacttttggcctaggggaccaggctggagatcagacgaactgtggc

SEQ ID NO: 588903 - DNA, 496 bp, Homo sapiens; identical to SEQ ID NO: 535541
  misc_feature: HIJSMM301ELCWI.3.33.C11.1.454.light.4.raw

SEQ ID NO: 588904 - DNA, 495 bp, Homo sapiens
  misc_feature: HIJSMM301EFU4K.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttcta

SEQ ID NO: 588905 - DNA, 502 bp, Homo sapiens
  misc_feature: HIJSMM301C5N5R.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcactttcggcgggggaccgaaggtggagttcgaaacgaactgtggctgcaccatctgtcttcatcttcccg

SEQ ID NO: 588906 - DNA, 474 bp, Homo sapiens
  misc_feature: HIJSMM301AKUBT.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagttttcccgcttcactttcggcggagggaccaaggtggagatcaaacgaa

SEQ ID NO: 588907 - DNA, 473 bp, Homo sapiens; identical to SEQ ID NO: 538875
  misc_feature: HIJSMM301BAA97.4.75.G09.1.454.light.4.raw

SEQ ID NO: 588908 - DNA, 383 bp, Homo sapiens; identical to SEQ ID NO: 447524
  misc_feature: HIJSMM301EFRDL.41.26.C04.1.454.light.4.raw

SEQ ID NO: 588909 - DNA, 489 bp, Homo sapiens; identical to SEQ ID NO: 535139
  misc_feature: HIJSMM301A6QOB.14.55.E11.1.454.light.4.raw

SEQ ID NO: 588910 - DNA, 495 bp, Homo sapiens; identical to SEQ ID NO: 538920
  misc_feature: HIJSMM301EZWQM.47.64.F09.1.454.light.4.raw

SEQ ID NO: 588911 - DNA, 447 bp, Homo sapiens; identical to SEQ ID NO: 535020
  misc_feature: HIJSMM301BY5O8.18.9.A09.1.454.light.4.raw

SEQ ID NO: 588912 - DNA, 517 bp, Homo sapiens
  misc_feature: HIJSMM301EF679.48.24.C02.1.454.light.4.raw
agtatacatacacgaccggtgctcgatttagtacagatcgttagggaaagggggggggagcctagctgtgctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcaggagtccaggcagaggacgaggctgactattactgtcagtctgcagacaacggaggtacttacttggtcttcggcggagggaccaagttgaacgtcctgggtcagcccaaggctcgccccctcggtctac

SEQ ID NO: 588913 - DNA, 489 bp, Homo sapiens; identical to SEQ ID NO: 535139
  misc_feature: HIJSMM301EMCR7.14.55.E11.1.454.light.4.raw

SEQ ID NO: 588914 - DNA, 512 bp, Homo sapiens
  misc_feature: HIJSMM301BLY1K.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccgccctcct

SEQ ID NO: 588915 - DNA, 489 bp, Homo sapiens
  misc_feature: HIJSMM301BMAL0.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggagtgttggcatttattactgcatgcaggctatacaccttcctgccacttttggccaggggaccaagctggagatcaggcgaacg

SEQ ID NO: 588916 - DNA, 500 bp, Homo sapiens; identical to SEQ ID NO: 542309
  misc_feature: HIJSMM301D05F6.12.86.H09.1.454.light.4.raw

SEQ ID NO: 588917 - DNA, 499 bp, Homo sapiens
  misc_feature: HIJSMM301D7INM.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctcctgaccgtctctgggctccaggctgaggatgaggctgattattactgcagctcatatgcaggcagcagcagtccccatgtgatcttcggcggggggaccaagctgaccgtcctaggtcagcccaagggct

SEQ ID NO: 588918 - DNA, 497 bp, Homo sapiens
  misc_feature: HIJSMM301B96CF.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagccctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaac

SEQ ID NO: 588919 - DNA, 500 bp, Homo sapiens
  misc_feature: HIJSMM301DF700.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactg

SEQ ID NO: 588920 - DNA, 479 bp, Homo sapiens; identical to SEQ ID NO: 536050
  misc_feature: HIJSMM301EJ9BN.5.73.G07.1.454.light.4.raw

SEQ ID NO: 588921 - DNA, 526 bp, Homo sapiens
  misc_feature: HIJSMM301AWOVL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcttcggtccgaacgggaccgaaacgggtagggaaaagttaccaaaacggaaacctagttggctggcacccatctgtcttctatcttcccccg

SEQ ID NO: 588922 - DNA, 499 bp, Homo sapiens
  misc_feature: HIJSMM301A54YL.22.15.B04.1.454.light.4.raw
  modified_base (304)..(304): a, c, t, g, unknown or other
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcnctaagcggccctcaggggtccctgatcgcttctctggctccaagtctggcaacacggcctccctgaccgtctctgggctccaggctgaggatgaggctgattattactgcagctcatatggaggcagcgacaatttgggtgttcgggcggagggaccaagctgaccgtcctaggtcagcccaaggcctcgccccc

SEQ ID NO: 588923 - DNA, 480 bp, Homo sapiens
  misc_feature: HIJSMM301CCRYP.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgttattttcggccctgggaccacagtagatatcaaacgaactgtggctgcacc

SEQ ID NO: 588924 - DNA, 495 bp, Homo sapiens
  misc_feature: HIJSMM301C9ZPI.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctgctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaagg

SEQ ID NO: 588925 - DNA, 508 bp, Homo sapiens
  misc_feature: HIJSMM301EYG4V.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaaagtggatatcaaacgaaactgtggctgcaccatctgtctt

SEQ ID NO: 588926 - DNA, 500 bp, Homo sapiens
  misc_feature: HIJSMM301CCUHP.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgacaccatctgtt

SEQ ID NO: 588927 - DNA, 487 bp, Homo sapiens; identical to SEQ ID NO: 536206
  misc_feature: HIJSMM301DLPPE.47.38.D05.1.454.light.4.raw

SEQ ID NO: 588928 - DNA, 461 bp, Homo sapiens
  misc_feature: HIJSMM301EGH7Q.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgtatcctagttgggtgttcggcggagggaccaggctgaccgtcctaggtcagcccaaggctgccccctcggtcactctgttcccaccctcctcacgcgtatgt

SEQ ID NO: 588929 - DNA, 487 bp, Homo sapiens
  misc_feature: HIJSMM301CSR3O.14.53.E09.1.454.light.4.raw
cgtctagtaccacgaccggtgctcgatttagagagagtgtgttgggtttgggggggaggcctagctgtgctgtgggtccgaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcgagggaccaagctgaccgtccta

SEQ ID NO: 588930 - DNA, 488 bp, Homo sapiens; identical to SEQ ID NO: 537124
  misc_feature: HIJSMM301DT0N7.11.25.C03.1.454.light.4.raw

SEQ ID NO: 588931 - DNA, 485 bp, Homo sapiens; identical to SEQ ID NO: 539315
  misc_feature: HIJSMM301BN1QR.3.88.H11.1.454.light.4.raw

SEQ ID NO: 588932 - DNA, 500 bp, Homo sapiens
  misc_feature: HIJSMM301DKGMC.43.53.E09.1.454.light.4.raw
tgtgagtagtcacgaccggtgctcgatttagagagagtgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaacccta

SEQ ID NO: 588933 - DNA, 496 bp, Homo sapiens; identical to SEQ ID NO: 537925
  misc_feature: HIJSMM301EJ7GI.22.14.B03.1.454.light.4.raw

SEQ ID NO: 588934 - DNA, 521 bp, Homo sapiens; identical to SEQ ID NO: 539470
  misc_feature: HIJSMM301EHLD4.27.23.C01.1.454.light.4.raw

SEQ ID NO: 588935 - DNA, 505 bp, Homo sapiens; identical to SEQ ID NO: 558614
  misc_feature: HIJSMM301CT3C9.8.19.B08.1.454.light.4.raw

SEQ ID NO: 588936 - DNA, 495 bp, Homo sapiens; identical to SEQ ID NO: 536931
  misc_feature: HIJSMM301BCEDJ.10.33.C11.1.454.light.4.raw

SEQ ID NO: 588937 - DNA, 486 bp, Homo sapiens
  misc_feature: HIJSMM301CEKA5.49.72.G06.1.454.light.4.raw
agtcgagagacacgaccggtgctcgatttagctacgactgcaagggaaaggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcacc

SEQ ID NO: 588938 - DNA, 485 bp, Homo sapiens
  misc_feature: HIJSMM301B46O2.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttggcggggacggaacggtaggagatacaacgaaactagtgcgtgcacca

SEQ ID NO: 588939 - DNA, 494 bp, Homo sapiens; identical to SEQ ID NO: 534992
  misc_feature: HIJSMM301DGCJI.9.1.A01.1.454.light.4.raw

SEQ ID NO: 588940 - DNA, 499 bp, Homo sapiens
  misc_feature: HIJSMM301B7N5I.19.78.H01.1.454.light.4.raw
  modified_base (481)..(481): a, c, t, g, unknown or other
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccnccctcctccacgagagta

SEQ ID NO: 588941 - DNA, 485 bp, Homo sapiens
  misc_feature: HIJSMM301CZMHS.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggttttattactgtcagcagtataatcagtggcctccgtggacgttcggccaagggaccaaggtggaaatcaaacgaactgtgg

SEQ ID NO: 588942 - DNA, 492 bp, Homo sapiens
  misc_feature: HIJSMM301CHP5A.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttctcttcccg

SEQ ID NO: 588943 - DNA, 502 bp, Homo sapiens; identical to SEQ ID NO: 575571
  misc_feature: HIJSMM301C7RQU.12.67.G01.1.454.light.4.raw

SEQ ID NO: 588944 - DNA, 486 bp, Homo sapiens
  misc_feature: HIJSMM301EE60D.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggacttcggtccaaggaccgaaggtaggaaatacaaacgaactgtggctgcaccta

SEQ ID NO: 588945 - DNA, 455 bp, Homo sapiens; identical to SEQ ID NO: 535447
  misc_feature: HIJSMM301BS1WK.19.71.G05.1.454.light.4.raw

SEQ ID NO: 588946 - DNA, 508 bp, Homo sapiens; identical to SEQ ID NO: 564177
  misc_feature: HIJSMM301A8P9T.17.28.C06.1.454.light.4.raw

SEQ ID NO: 588947 - DNA, 513 bp, Homo sapiens
  misc_feature: HIJSMM301EGR8O.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagctggccgtctaggtcagcccaaggctcgccccctggtcactctcgttcccaccctcctcgagtagtaca

SEQ ID NO: 588948 - DNA, 483 bp, Homo sapiens
  misc_feature: HIJSMM301D6PR0.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaaggctctacaagtcccgctcactttcggcgagggaccaaggtggagatcaacgaa

SEQ ID NO: 588949 - DNA, 495 bp, Homo sapiens; identical to SEQ ID NO: 539288
  misc_feature: HIJSMM301C4LEK.9.1.A01.1.454.light.4.raw

SEQ ID NO: 588950 - DNA, 511 bp, Homo sapiens; identical to SEQ ID NO: 541549
  misc_feature: HIJSMM301CE222.40.33.C11.1.454.light.4.raw

SEQ ID NO: 588951 - DNA, 513 bp, Homo sapiens
  misc_feature: HIJSMM301B4YT9.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgcctcctcg

SEQ ID NO: 588952 - DNA, 496 bp, Homo sapiens; identical to SEQ ID NO: 536248
  misc_feature: HIJSMM301CP9XO.22.27.C05.1.454.light.4.raw

SEQ ID NO: 588953 - DNA, 483 bp, Homo sapiens
  misc_feature: HIJSMM301AO8MZ.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagactcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccgaagggaccgagggtaggaaatcaaacgaactggtggctgcaccat

SEQ ID NO: 588954 - DNA, 502 bp, Homo sapiens
  misc_feature: HIJSMM301CRORK.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaaggctgaccgtcctaggtcagcccaaggctgccccctcggtcactctcg

SEQ ID NO: 588955 - DNA, 512 bp, Homo sapiens; identical to SEQ ID NO: 548157
  misc_feature: HIJSMM301D2ZCR.17.33.C11.1.454.light.4.raw

SEQ ID NO: 588956 - DNA, 485 bp, Homo sapiens
  misc_feature: HIJSMM301A4FFA.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggacaaactggatatcagacgaactgtgg

SEQ ID NO: 588957 - DNA, 512 bp, Homo sapiens
  misc_feature: HIJSMM301EIRDZ.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactcttcg

SEQ ID NO: 588958 - DNA, 494 bp, Homo sapiens; identical to SEQ ID NO: 551626
  misc_feature: HIJSMM301BKIDK.11.59.F04.1.454.light.4.raw

SEQ ID NO: 588959 - DNA, 510 bp, Homo sapiens
  misc_feature: HIJSMM301CAX0P.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttccttaaattaggcgccactctcgtggttttcggcggaggcaccgaagtgaccgtcctcggtcagcccaaggctgccccctcggtcact

SEQ ID NO: 588960 - DNA, 496 bp, Homo sapiens
  misc_feature: HIJSMM301CYX31.5.57.F02.1.454.light.4.raw
  modified_base (483)..(483): a, c, t, g, unknown or other
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgtcgtcgacggacgacgacaggatagtatagcgacgtaagtcgtcgngtcgcacactact

SEQ ID NO: 588961 - DNA, 495 bp, Homo sapiens; identical to SEQ ID NO: 551704
  misc_feature: HIJSMM301AWSPS.13.6.A06.1.454.light.4.raw

SEQ ID NO: 588962 - DNA, 507 bp, Homo sapiens
  misc_feature: HIJSMM301EDPYA.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggaccaggtggaagtcagcgaactgtggctgcaccatctgtctttatcttcccgcc

SEQ ID NO: 588963 - DNA, 495 bp, Homo sapiens
  misc_feature: HIJSMM301DSMWV.3.35.D02.1.454.light.4.raw
agacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttattctgcatgcaagctacacactggccgtacacttttggccaggggaccaagctggagatcaaacgaactgtggctgcacc

SEQ ID NO: 588964 - DNA, 494 bp, Homo sapiens; identical to SEQ ID NO: 536221
  misc_feature: HIJSMM301BGT92.15.59.F04.1.454.light.4.raw

SEQ ID NO: 588965 - DNA, 509 bp, Homo sapiens
  misc_feature: HIJSMM301C048A.8.1.A01.1.454.light.4.raw
  modified_base (413)..(413): a, c, t, g, unknown or other
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttattggtaccagcagaagtcaggccaggcccctgtcctggtcatttatgaggacaagaaacgacccctccgggatccctgacagactctctggctccagctcagggacagtggccaccttgactatcactggggcccaggtggaggatgaaggagactactattgttactctccaganaaggatggtcatcattgggtgttcggcggagggaccaagctgaccgtcaagtcagcccaaggctcgccccctcggtcactctgttccccaccctcc

SEQ ID NO: 588966 - DNA, 479 bp, Homo sapiens
  misc_feature: HIJSMM301C8DKQ.48.72.G06.1.454.light.4.raw
agtatacatacacgaccggtgctcgatttagctacgactgcaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctac

SEQ ID NO: 588967 - DNA, 521 bp, Homo sapiens; identical to SEQ ID NO: 539470
  misc_feature: HIJSMM301BCQE0.27.23.C01.1.454.light.4.raw

SEQ ID NO: 588968 - DNA, 493 bp, Homo sapiens; identical to SEQ ID NO: 535745
  misc_feature: HIJSMM301A6L1B.47.78.H01.1.454.light.4.raw

SEQ ID NO: 588969 - DNA, 506 bp, Homo sapiens
  misc_feature: HIJSMM301BWPVB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaatacaaacgaactagtggctgcaccatctgtcttctatcttccccg

SEQ ID NO: 588970 - DNA, 524 bp, Homo sapiens
  misc_feature: HIJSMM301APQDI.16.59.F04.1.454.light.4.raw
tgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgagtagtaca

SEQ ID NO: 588971 - DNA, 522 bp, Homo sapiens; identical to SEQ ID NO: 554788
  misc_feature: HIJSMM301BAR4Y.27.23.C01.1.454.light.4.raw
  modified_base (518)..(518): a, c, t, g, unknown or other

SEQ ID NO: 588972 - DNA, 482 bp, Homo sapiens
  misc_feature: HIJSMM301C2XMT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcagctctacaagtcccgctcactttcggcggagggaccaaggtggagatcaaacga

SEQ ID NO: 588973 - DNA, 483 bp, Homo sapiens
  misc_feature: HIJSMM301CKWK0.49.37.D04.1.454.light.4.raw
agtcgagagacacgaccggtgctcgatttagtagcatactgttgggtttggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcacc

SEQ ID NO: 588974 - DNA, 504 bp, Homo sapiens; identical to SEQ ID NO: 535561
  misc_feature: HIJSMM301A5KE6.4.57.F02.1.454.light.4.raw

SEQ ID NO: 588975 - DNA, 416 bp, Homo sapiens; identical to SEQ ID NO: 536892
  misc_feature: HIJSMM301AXR69.16.46.E02.1.454.light.4.raw

SEQ ID NO: 588976 - DNA, 487 bp, Homo sapiens
  misc_feature: HIJSMM301BP0RI.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtggggcgcgcgttttcggcgggggaccgaaggtggacatcaaacgaactgtggctgcaccatct

SEQ ID NO: 588977 - DNA, 509 bp, Homo sapiens
  misc_feature: HIJSMM301D7F8G.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagccaaggctgccccctcggtcactctgttt

SEQ ID NO: 588978 - DNA, 505 bp, Homo sapiens; identical to SEQ ID NO: 537876
  misc_feature: HIJSMM301EUTB9.5.68.G02.1.454.light.4.raw

SEQ ID NO: 588979 - DNA, 495 bp, Homo sapiens; identical to SEQ ID NO: 538277
  misc_feature: HIJSMM301C9NQE.16.53.E09.1.454.light.4.raw

SEQ ID NO: 588980 - DNA, 499 bp, Homo sapiens; identical to SEQ ID NO: 542463
  misc_feature: HIJSMM301B792C.26.26.C04.1.454.light.4.raw

SEQ ID NO: 588981 - DNA, 511 bp, Homo sapiens; identical to SEQ ID NO: 537464
  misc_feature: HIJSMM301A88AN.7.34.D01.1.454.light.4.raw

SEQ ID NO: 588982 - DNA, 495 bp, Homo sapiens; identical to SEQ ID NO: 554875
  misc_feature: HIJSMM301A3Y0S.22.86.H09.1.454.light.4.raw

SEQ ID NO: 588983 - DNA, 494 bp, Homo sapiens; identical to SEQ ID NO: 537805
  misc_feature: HIJSMM301CLHPZ.51.6.A06.1.454.light.4.raw

SEQ ID NO: 588984 - DNA, 494 bp, Homo sapiens; identical to SEQ ID NO: 558889
  misc_feature: HIJSMM301EFUWE.47.78.H01.1.454.light.4.raw

SEQ ID NO: 588985 - DNA, 518 bp, Homo sapiens; identical to SEQ ID NO: 581602
  misc_feature: HIJSMM301BTNSS.3.87.H10.1.454.light.4.raw

SEQ ID NO: 588986 - DNA, 502 bp, Homo sapiens; identical to SEQ ID NO: 537363
  misc_feature: HIJSMM301A5BGK.18.23.C01.1.454.light.4.raw

SEQ ID NO: 588987 - DNA, 488 bp, Homo sapiens
  misc_feature: HIJSMM301B6FF0.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatcacttttggccagggaccaagctggacgatcaaacgaactgtggctgcacca

SEQ ID NO: 588988 - DNA, 487 bp, Homo sapiens
  misc_feature: HIJSMM301BLIVH.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctcagcgttcggccaggggaccaaggtggaagtcaagcgaactgtggctgcaccatctgt

SEQ ID NO: 588989 - DNA, 495 bp, Homo sapiens
  misc_feature: HIJSMM301AQPDJ.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcgggacgttcggccaagggaccgaacggtggaagtcaaacgaactagtggctgcaccatctgtctt

SEQ ID NO: 588990 - DNA, 504 bp, Homo sapiens; identical to SEQ ID NO: 538940
  misc_feature: HIJSMM301D1JHU.2.35.D02.1.454.light.4.raw

SEQ ID NO: 588991 - DNA, 501 bp, Homo sapiens
  misc_feature: HIJSMM301CM3I5.48.59.F04.1.454.light.4.raw
agtatacatacacgaccggtgctcgatttagtacacacacttagggattgggggggaaccatggaaacccagcgcagcttctcttcctcctgctactctggctcccagatgcccccggagaaattgtgttgacgcagtctccagacaccctgtctttgtctccaggggaaagagccaccttctcctgcaggttcagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcactcttcccgccatctgatatgtatacttcg

SEQ ID NO: 588992 - DNA, 450 bp, Homo sapiens
  misc_feature: HIJSMM301DT5HY.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagcttccagggacacgcccccaaactcctcatctttggtagcaacaatcggccctcgaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 588993 - DNA, 518 bp, Homo sapiens
  misc_feature: HIJSMM301AHAR9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcggtccaacgggaccgaacggtaggaaagtacaaacgaaactacgtaggcgtgcgaccactctcgtcttctactcttccccg

SEQ ID NO: 588994 - DNA, 494 bp, Homo sapiens
  misc_feature: HIJSMM301A1MOW.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacactttgggtgttcggcgagggaccaagctgaccgtcctaggtcagcccaaggctgccccctcggtcactctgtcccacctcct

SEQ ID NO: 588995 - DNA, 470 bp, Homo sapiens; identical to SEQ ID NO: 535302
  misc_feature: HIJSMM301EPUSV.13.76.G10.1.454.light.4.raw

SEQ ID NO: 588996 - DNA, 494 bp, Homo sapiens; identical to SEQ ID NO: 535828
  misc_feature: HIJSMM301CK0L2.3.36.D03.1.454.light.4.raw

SEQ ID NO: 588997 - DNA, 502 bp, Homo sapiens
  misc_feature: HIJSMM301CEAHT.17.61.F06.1.454.light.4.raw
  modified_base (462)..(462): a, c, t, g, unknown or other
cgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtnttcggcgagggaccaagctgaccgtcctaggtcagcccaa

SEQ ID NO: 588998 - DNA, 503 bp, Homo sapiens
  misc_feature: HIJSMM301B1SIU.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactgagcctgaagattttgcagtgtattactgtcagcagtatggtagctcacggacgttcggccaagggaccgaaggtggaagtcaaacgaactagtggctgcaccatctgtcttctatcttcccgccta

SEQ ID NO: 588999 - DNA, 500 bp, Homo sapiens; identical to SEQ ID NO: 546596
  misc_feature: HIJSMM301BXQIQ.18.59.F04.1.454.light.4.raw

SEQ ID NO: 589000 - DNA, 521 bp, Homo sapiens; identical to SEQ ID NO: 538715
  misc_feature: HIJSMM301D8MSW.27.23.C01.1.454.light.4.raw

SEQ ID NO: 589001 - DNA, 494 bp, Homo sapiens; identical to SEQ ID NO: 543247
  misc_feature: HIJSMM301C0PIN.22.57.F02.1.454.light.4.raw

SEQ ID NO: 589002 - DNA, 454 bp, Homo sapiens; identical to SEQ ID NO: 534964
  misc_feature: HIJSMM301DACSE.19.86.H09.1.454.light.4.raw

SEQ ID NO: 589003 - DNA, 494 bp, Homo sapiens
  misc_feature: HIJSMM301BCTTX.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaacccactgtcact

SEQ ID NO: 589004 - DNA, 502 bp, Homo sapiens
  misc_feature: HIJSMM301B98UA.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcgagggaccaagctgaccgtcctggtcagcccaaggctgccccctcggtca

SEQ ID NO: 589005 - DNA, 499 bp, Homo sapiens
  misc_feature: HIJSMM301BRUDH.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcggcggagggaccaaggtggagatcaaacgaactgtggctgcaccta

SEQ ID NO: 589006 - DNA, 488 bp, Homo sapiens; identical to SEQ ID NO: 537260
  misc_feature: HIJSMM301A682E.47.70.G04.1.454.light.4.raw

SEQ ID NO: 589007 - DNA, 495 bp, Homo sapiens
  misc_feature: HIJSMM301BFUXM.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggggaccaagctggagatcaaacgaactgtggc

SEQ ID NO: 589008 - DNA, 488 bp, Homo sapiens; identical to SEQ ID NO: 536056
  misc_feature: HIJSMM301D845Y.47.36.D03.1.454.light.4.raw

SEQ ID NO: 589009 - DNA, 489 bp, Homo sapiens
  misc_feature: HIJSMM301DRNVS.48.22.B11.1.454.light.4.raw
agtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgctaacttattactgtcaacagcttaagtacgtaaccctccgtactacttttggccaggggaccaaggtggaagatacaaacgaactggtgctgcaccatctgtctt

SEQ ID NO: 589010 - DNA, 491 bp, Homo sapiens
  misc_feature: HIJSMM301D37H4.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaaagctggagatcaatcgaactgt

SEQ ID NO: 589011 - DNA, 519 bp, Homo sapiens
  misc_feature: HIJSMM301BYPJC.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctcgttccacct

SEQ ID NO: 589012 - DNA, 494 bp, Homo sapiens; identical to SEQ ID NO: 534992
  misc_feature: HIJSMM301BC506.9.1.A01.1.454.light.4.raw

SEQ ID NO: 589013 - DNA, 444 bp, Homo sapiens; identical to SEQ ID NO: 535594
  misc_feature: HIJSMM301DY8F4.9.9.A09.1.454.light.4.raw

SEQ ID NO: 589014 - DNA, 482 bp, Homo sapiens; identical to SEQ ID NO: 535796
  misc_feature: HIJSMM301DQXY1.51.64.F09.1.454.light.4.raw

SEQ ID NO: 589015 - DNA, 504 bp, Homo sapiens; identical to SEQ ID NO: 539091
  misc_feature: HIJSMM301BL10A.8.28.C06.1.454.light.4.raw

SEQ ID NO: 589016 - DNA, 508 bp, Homo sapiens; identical to SEQ ID NO: 586732
  misc_feature: HIJSMM301EQ1J1.16.1.A01.1.454.light.4.raw

SEQ ID NO: 589017 - DNA, 513 bp, Homo sapiens; identical to SEQ ID NO: 561323
  misc_feature: HIJSMM301B1QU2.43.19.B08.1.454.light.4.raw

SEQ ID NO: 589018 - DNA, 486 bp, Homo sapiens
  misc_feature: HIJSMM301AT307.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctcctgcatagtaatggagacaactatttggattgggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 589019 - DNA, 484 bp, Homo sapiens; identical to SEQ ID NO: 536162
  misc_feature: HIJSMM301CPCOF.13.59.F04.1.454.light.4.raw

SEQ ID NO: 589020 - DNA, 494 bp, Homo sapiens; identical to SEQ ID NO: 543242
  misc_feature: HIJSMM301CVXYN.27.78.H01.1.454.light.4.raw
  modified_base (462)..(462): a, c, t, g, unknown or other

SEQ ID NO: 589021 - DNA, 508 bp, Homo sapiens
  misc_feature: HIJSMM301EFFES.8.42.D09.1.454.light.4.raw
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccacct

SEQ ID NO: 589022 - DNA, 470 bp, Homo sapiens; identical to SEQ ID NO: 535302
  misc_feature: HIJSMM301BQYZG.13.76.G10.1.454.light.4.raw

SEQ ID NO: 589023 - DNA, 506 bp, Homo sapiens
  misc_feature: HIJSMM301EDJ7W.9.55.E11.1.454.light.4.raw
  modified_base (427)..(427): a, c, t, g, unknown or other
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacgccaccctgaccatcagcagggtcgaagccgggatgaggccgactattactgtcaggtgtgggctggtgataangatcatgcgggggtgttcggcggagggaccaagctgaccgtcctaagtcagcccaaggctgccccctcggtcactctcg

SEQ ID NO: 589024 - DNA, 504 bp, Homo sapiens
  misc_feature: HIJSMM301C3TRU.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacattcggccgaagggaccaaggtaggaaatcaaaacgaacgtgtggctgcaccta

SEQ ID NO: 589025 - DNA, 472 bp, Homo sapiens
  misc_feature: HIJSMM301BGHDJ.5.14.B03.1.454.light.4.raw
atcagacacgcacgaccggtgctcgatttagtgtgagtagttccgcgggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtgg

SEQ ID NO: 589026 - DNA, 455 bp, Homo sapiens
  misc_feature: HIJSMM301CBX7J.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccacccctcctccacgagagta

SEQ ID NO: 589027 - DNA, 463 bp, Homo sapiens; identical to SEQ ID NO: 535062
  misc_feature: HIJSMM301B39QC.11.73.G07.1.454.light.4.raw

SEQ ID NO: 589028 - DNA, 487 bp, Homo sapiens
  misc_feature: HIJSMM301ADOR6.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactgggtttccccagccaggttcagtggcagtgcgtctgcgacagagttcactctcaccatcaacagcctgcagtctgaagattttgcagtttattactgtcagcagtatcatgactggccgctcacccttcggccaagggacacgactggagattaaacgaactgtggctgcaccat

SEQ ID NO: 589029 - DNA, 502 bp, Homo sapiens; identical to SEQ ID NO: 541501
  misc_feature: HIJSMM301DF2A7.17.27.C05.1.454.light.4.raw

SEQ ID NO: 589030 - DNA, 523 bp, Homo sapiens
  misc_feature: HIJSMM301DW1NL.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggccaggctgaccgtcctaggtcagcccaaggctgccccctcggtcactctgttcccaccctcc

SEQ ID NO: 589031 - DNA, 495 bp, Homo sapiens; identical to SEQ ID NO: 559417
  misc_feature: HIJSMM301BYH7F.26.12.B01.1.454.light.4.raw

SEQ ID NO: 589032 - DNA, 486 bp, Homo sapiens; identical to SEQ ID NO: 542999
  misc_feature: HIJSMM301EIGS7.17.55.E11.1.454.light.4.raw

SEQ ID NO: 589033 - DNA, 510 bp, Homo sapiens
  misc_feature: HIJSMM301EBAQO.40.12.B01.1.454.light.4.raw
tctagcgactcacgaccggtgctcgatttagtagtgtagattccgcgggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgtt

SEQ ID NO: 589034 - DNA, 484 bp, Homo sapiens; identical to SEQ ID NO: 535400
  misc_feature: HIJSMM301C2C3L.46.26.C04.1.454.light.4.raw

SEQ ID NO: 589035 - DNA, 487 bp, Homo sapiens
  misc_feature: HIJSMM301AYI9G.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctgttccccaccctcctcgctacgtaga

SEQ ID NO: 589036 - DNA, 487 bp, Homo sapiens
  misc_feature: HIJSMM301AVF2G.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcggagatcagacgaactgtggctgcaccatctgtcttc

SEQ ID NO: 589037 - DNA, 506 bp, Homo sapiens
  misc_feature: HIJSMM301CLK1X.21.22.B11.1.454.light.4.raw
  modified_base (430)..(430): a, c, t, g, unknown or other
  modified_base (462)..(462): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtnttcgggcggagggaccaaaactgaaccgtcctaggtcagcccaa

SEQ ID NO: 589038 - DNA, 478 bp, Homo sapiens; identical to SEQ ID NO: 541670
  misc_feature: HIJSMM301DBTUS.13.73.G07.1.454.light.4.raw

SEQ ID NO: 589039 - DNA, 521 bp, Homo sapiens; identical to SEQ ID NO: 538715
  misc_feature: HIJSMM301D0PTD.27.23.C01.1.454.light.4.raw

SEQ ID NO: 589040 - DNA, 522 bp, Homo sapiens
  misc_feature: HIJSMM301EE3O7.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacactttgggtgttcggcggagggaccaggctgaccgtcctaggtcagcccaaggctgccccctcggtcactctgttcccaccct

SEQ ID NO: 589041 - DNA, 444 bp, Homo sapiens; identical to SEQ ID NO: 534993
  misc_feature: HIJSMM301BPRR0.5.9.A09.1.454.light.4.raw

SEQ ID NO: 589042 - DNA, 488 bp, Homo sapiens
  misc_feature: HIJSMM301CEONV.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggcctggaccatagtggatatgaaacgaactgtggctgcaccattc

SEQ ID NO: 589043 - DNA, 499 bp, Homo sapiens
  misc_feature: HIJSMM301DBB2R.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtctaggtcagcccaagctgcccctc

SEQ ID NO: 589044 - DNA, 493 bp, Homo sapiens; identical to SEQ ID NO: 536471
  misc_feature: HIJSMM301AS70L.3.71.G05.1.454.light.4.raw

SEQ ID NO: 589045 - DNA, 384 bp, Homo sapiens
  misc_feature: HIJSMM301A2KQ7.41.26.C04.1.454.light.4.raw
tctatactatcacgaccggtgctcgatttagtctagcgactttggggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 589046 - DNA, 492 bp, Homo sapiens
  misc_feature: HIJSMM301CEJHL.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaaggacacgactggagattaaacgaactgtggctgcaccatctgtctt

SEQ ID NO: 589047 - DNA, 500 bp, Homo sapiens
  misc_feature: HIJSMM301ECWIH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcgccaagggacacgactggagattaaaaggaaatgtggctgcacccaatctgtcttctaactcttccccg

SEQ ID NO: 589048 - DNA, 499 bp, Homo sapiens
  misc_feature: HIJSMM301C389S.48.37.D04.1.454.light.4.raw
agtatacatacacgaccggtgctcgatttagtagcatactgttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctcctgacaatctctgggctccaggctgaggacgaggctgattattattgctgctcatatgcaggtggtactacttgggtgttcggcagagggaccaagctgaccgtcctaggtcagcccaaggctgcccccc

SEQ ID NO: 589049 - DNA, 507 bp, Homo sapiens
  misc_feature: HIJSMM301EQSW5.51.35.D02.1.454.light.4.raw
cgatcgtatacacgaccggtgctcgatttagcacacgatagttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggtttattactgcatgcaaggtacacactggcctgggacgttcggccaagggaccaaggtggaaatcaaacgaactgtggctgcaccatctgtcttcat

SEQ ID NO: 589050 - DNA, 513 bp, Homo sapiens; identical to SEQ ID NO: 539258
  misc_feature: HIJSMM301EDFVE.43.19.B08.1.454.light.4.raw

SEQ ID NO: 589051 - DNA, 511 bp, Homo sapiens; identical to SEQ ID NO: 573526
  misc_feature: HIJSMM301ATA37.15.34.D01.1.454.light.4.raw

SEQ ID NO: 589052 - DNA, 488 bp, Homo sapiens; identical to SEQ ID NO: 535861
  misc_feature: HIJSMM301BW5ZA.14.55.E11.1.454.light.4.raw

SEQ ID NO: 589053 - DNA, 521 bp, Homo sapiens; identical to SEQ ID NO: 539470
  misc_feature: HIJSMM301DC31W.27.23.C01.1.454.light.4.raw

SEQ ID NO: 589054 - DNA, 473 bp, Homo sapiens
  misc_feature: HIJSMM301D2EON.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggaccgaaggtggagagtcaaacgaa

SEQ ID NO: 589055 - DNA, 493 bp, Homo sapiens
  misc_feature: HIJSMM301C52QF.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacgaactgtggctgcaccatctgtctt

SEQ ID NO: 589056 - DNA, 490 bp, Homo sapiens
  misc_feature: HIJSMM301DKWSP.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcgtctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggcctacggggaccaagctggagatcacaggaactgtggctgcaccat

SEQ ID NO: 589057 - DNA, 510 bp, Homo sapiens
  misc_feature: HIJSMM301EV0I0.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtccactctgttcccg

SEQ ID NO: 589058 - DNA, 501 bp, Homo sapiens; identical to SEQ ID NO: 538461
  misc_feature: HIJSMM301D03CR.13.11.A11.1.454.light.4.raw

SEQ ID NO: 589059 - DNA, 507 bp, Homo sapiens
  misc_feature: HIJSMM301EZ35D.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccaaggtcggacctacaaacgaactgtggctgcacatctgtcttcatcttcccgcc

SEQ ID NO: 589060 - DNA, 509 bp, Homo sapiens; identical to SEQ ID NO: 553073
  misc_feature: HIJSMM301DVFPZ.16.1.A01.1.454.light.4.raw

SEQ ID NO: 589061 - DNA, 483 bp, Homo sapiens; identical to SEQ ID NO: 549634
  misc_feature: HIJSMM301CXE2H.26.78.H01.1.454.light.4.raw

SEQ ID NO: 589062 - DNA, 506 bp, Homo sapiens
  misc_feature: HIJSMM301BRIFO.21.22.B11.1.454.light.4.raw
  modified_base (414)..(414): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattacngtgcatcacgggacgcaacatgggatgacaatctgagcggttgggtgttcggcggagggaccaaaactggaccgtcctagggtcagccccaa

SEQ ID NO: 589063 - DNA, 444 bp, Homo sapiens; identical to SEQ ID NO: 536096
  misc_feature: HIJSMM301EDHK1.7.18.B07.1.454.light.4.raw

SEQ ID NO: 589064 - DNA, 498 bp, Homo sapiens
  misc_feature: HIJSMM301DITRV.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtgtaacattgtgatattcggcggagggaccaaggtgaccgtcctacgtcagcccaaggctgccccctcggtcactcttccg

SEQ ID NO: 589065 - DNA, 484 bp, Homo sapiens
  misc_feature: HIJSMM301C1IAL.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagatttgcaacttactattgtcaacaggctaacagtttcccttaatcttcggccaagggacacgaactgagattaaacgaactgtggctgcaccta

SEQ ID NO: 589066 - DNA, 484 bp, Homo sapiens; identical to SEQ ID NO: 535400
  misc_feature: HIJSMM301BIZ7X.46.26.C04.1.454.light.4.raw

SEQ ID NO: 589067 - DNA, 481 bp, Homo sapiens
  misc_feature: HIJSMM301EDGIB.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactccctgatctatacggcatctactttacagagtggggtcccatcaaggttcagcggcagtgcatctgggacagaattcactctcaccatcagcagcctgcagcctgatgattttgcaacttattacttgccaacagtattatacttatccatggacgttcggccaagggaccaaggtggaaatcaaacgaactagtggctgcaccat

SEQ ID NO: 589068 - DNA, 505 bp, Homo sapiens
  misc_feature: HIJSMM301DDU4F.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtaggaaatacaaacgaactagtggctgcaccatctgtcttcatcttcccg

SEQ ID NO: 589069 - DNA, 506 bp, Homo sapiens; identical to SEQ ID NO: 543993
  misc_feature: HIJSMM301CEL9Z.18.78.H01.1.454.light.4.raw

SEQ ID NO: 589070 - DNA, 510 bp, Homo sapiens; identical to SEQ ID NO: 561652
  misc_feature: HIJSMM301DJSLE.17.2.A02.1.454.light.4.raw

SEQ ID NO: 589071 - DNA, 486 bp, Homo sapiens; identical to SEQ ID NO: 565619
  misc_feature: HIJSMM301AFNNG.5.40.D07.1.454.light.4.raw

SEQ ID NO: 589072 - DNA, 507 bp, Homo sapiens; identical to SEQ ID NO: 545328
  misc_feature: HIJSMM301DKXQK.8.33.C11.1.454.light.4.raw

SEQ ID NO: 589073 - DNA, 503 bp, Homo sapiens; identical to SEQ ID NO: 551847
  misc_feature: HIJSMM301DOUVG.27.78.H01.1.454.light.4.raw
  modified_base (495)..(495): a, c, t, g, unknown or other

SEQ ID NO: 589074 - DNA, 499 bp, Homo sapiens
  misc_feature: HIJSMM301DWIF5.13.42.D09.1.454.light.4.raw
tcacgtactacacgaccggtgctcgatttagacacatacgcagggaaaggggagaggctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgtcgtccgaacggaccgaacggtggaaatacgtaaacgaacgtagtggcgtgcaccactact

SEQ ID NO: 589075 - DNA, 501 bp, Homo sapiens
  misc_feature: HIJSMM301AWVSC.19.67.G01.1.454.light.4.raw
  modified_base (406)..(406): a, c, t, g, unknown or other
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagntgtggcagtttatactgtcagcaatatttttctatcctccgtggacttcggccaagggaccagggtggaaatcagacgaactgtggctgcaccat

SEQ ID NO: 589076 - DNA, 504 bp, Homo sapiens; identical to SEQ ID NO: 538940
  misc_feature: HIJSMM301BOFL6.2.35.D02.1.454.light.4.raw

SEQ ID NO: 589077 - DNA, 504 bp, Homo sapiens
  misc_feature: HIJSMM301DWJHM.22.27.C05.1.454.light.4.raw
acatacgcgtcacgaccggtgctcgatttagacgcgatcgaagggtttgggggaggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatcccggggtccctgaccgattcagtggcagcgggtctgggacagatttcactctcaccatcagcagcctgcaggctgaagatgtggcagtttattactgtcagcaatattatattcctcctcagacgttcggccaagggaccaagggtaggaaatcaaacgaactgtggctgcaccta

SEQ ID NO: 589078 - DNA, 489 bp, Homo sapiens; identical to SEQ ID NO: 540424
  misc_feature: HIJSMM301D4CQ0.17.25.C03.1.454.light.4.raw

SEQ ID NO: 589079 - DNA, 507 bp, Homo sapiens; identical to SEQ ID NO: 561702
  misc_feature: HIJSMM301AQ16H.5.24.C02.1.454.light.4.raw

SEQ ID NO: 589080 - DNA, 505 bp, Homo sapiens; identical to SEQ ID NO: 535503
  misc_feature: HIJSMM301ALC0Z.8.28.C06.1.454.light.4.raw

SEQ ID NO: 589081 - DNA, 484 bp, Homo sapiens
  misc_feature: HIJSMM301DPRZS.41.61.F06.1.454.light.4.raw
tctatactatcacgaccggtgctcgatttagctacgctctaagggaaaggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgactcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacagggtaacagtttccctctcactttcggcggagggaccaaggtggagatcaaacgaactgtggctgcaccat

SEQ ID NO: 589082 - DNA, 494 bp, Homo sapiens
  misc_feature: HIJSMM301C4HPA.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccccgacaggttcagtggcagtggatcaggcacagattttacactgaaaatcagcagagtggaggctgaggatgttggggtttattactgcatgcaagctctacaaactccgctcactttcggcggagggaccaaggtggagatcaaacgaactgtggctgca

SEQ ID NO: 589083 - DNA, 507 bp, Homo sapiens; identical to SEQ ID NO: 538063
  misc_feature: HIJSMM301A090L.47.85.H08.1.454.light.4.raw

SEQ ID NO: 589084 - DNA, 494 bp, Homo sapiens; identical to SEQ ID NO: 541183
  misc_feature: HIJSMM301CGZBW.19.71.G05.1.454.light.4.raw

SEQ ID NO: 589085 - DNA, 501 bp, Homo sapiens
  misc_feature: HIJSMM301A37D9.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctggactattactgtcaatcaacagacagtagtggtacttatgtgcagttcggcggagggaccaagctgaccgtcctaggtcagcccaaggctgccccctcggtcactc

SEQ ID NO: 589086 - DNA, 493 bp, Homo sapiens
  misc_feature: HIJSMM301CAHZQ.52.37.D04.1.454.light.4.raw
cgcagtacgacacgaccggtgctcgatttagtagcatactgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctcgtgggactgagcgctacctcaccatctccagcctccagtctgaggacgagggtgactattactgtcagacgtgggacacgtggctagtttggggtgttcgggcgggagggaccaagttgaccgtcctaggtcagcccaaggctcccg

SEQ ID NO: 589087 - DNA, 501 bp, Homo sapiens
  misc_feature: HIJSMM301E0L4K.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcacgcctgcaggctgaagatgtggctagtttattactgtcagcagtattatagtactcctccgacgttcgccgaaggaccgaggtaggagattaaacgaactagtggctgcacctatcgttgtcttctcttcctcccgaccta

SEQ ID NO: 589088 - DNA, 474 bp, Homo sapiens; identical to SEQ ID NO: 536662
  misc_feature: HIJSMM301CZ0JB.40.59.F04.1.454.light.4.raw

SEQ ID NO: 589089 - DNA, 503 bp, Homo sapiens
  misc_feature: HIJSMM301CRCUH.40.33.C11.1.454.light.4.raw
tctagcgactcacgaccggtgctcgatttagagtgagctcgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 589090 - DNA, 499 bp, Homo sapiens
  misc_feature: HIJSMM301DFV9U.48.53.E09.1.454.light.4.raw
agtatacatacacgaccggtgctcgatttagagagagtgtgttgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttcccg

SEQ ID NO: 589091 - DNA, 505 bp, Homo sapiens
  misc_feature: HIJSMM301CCB1M.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcggtcactcc

SEQ ID NO: 589092 - DNA, 512 bp, Homo sapiens
  misc_feature: HIJSMM301BXG3Y.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctcgccccctcggtcactctgttcctaccctcctcgctacgtaga

SEQ ID NO: 589093 - DNA, 495 bp, Homo sapiens
  misc_feature: HIJSMM301C78JY.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccgggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 589094 - DNA, 497 bp, Homo sapiens
  misc_feature: HIJSMM301CSQT7.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 589095 - DNA, 519 bp, Homo sapiens
  misc_feature: HIJSMM301C2MCJ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgtcccgccct

SEQ ID NO: 589096 - DNA, 487 bp, Homo sapiens; identical to SEQ ID NO: 574426
  misc_feature: HIJSMM301APJH6.46.35.D02.1.454.light.4.raw

SEQ ID NO: 589097 - DNA, 497 bp, Homo sapiens; identical to SEQ ID NO: 534982
  misc_feature: HIJSMM301CRXN4.26.80.H03.1.454.light.4.raw

SEQ ID NO: 589098 - DNA, 512 bp, Homo sapiens
  misc_feature: HIJSMM301CJTIU.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccgcctcct

SEQ ID NO: 589099 - DNA, 481 bp, Homo sapiens
  misc_feature: HIJSMM301D6H0M.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattatttattgccagtcctatgacaacaccctgcgtggttttgcgtgttcggcggcgggac

SEQ ID NO: 589100 - DNA, 504 bp, Homo sapiens; identical to SEQ ID NO: 554247
  misc_feature: HIJSMM301A07X7.19.78.H01.1.454.light.4.raw

SEQ ID NO: 589101 - DNA, 454 bp, Homo sapiens; identical to SEQ ID NO: 534964
  misc_feature: HIJSMM301ENCKU.19.86.H09.1.454.light.4.raw

SEQ ID NO: 589102 - DNA, 510 bp, Homo sapiens
  misc_feature: HIJSMM301D0R1K.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccgaaggtggagatcaagcgaactgtggctgcaccatctgtcttcatcttcccg

SEQ ID NO: 589103 - DNA, 472 bp, Homo sapiens
  misc_feature: HIJSMM301C3TIQ.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagccctaagctcctgatctatgctgcatccagtttgcaaagtggggtcccatcaaggttcagtggcagtggatctgggacagatttcactctcaccatcaacagtctgcaacctgaagatttgcaacttactactgtcaacagagttcactaccctcctcacttcggtcgggggaccgaacggtaggagatacaacgaa

SEQ ID NO: 589104 - DNA, 494 bp, Homo sapiens; identical to SEQ ID NO: 534992
  misc_feature: HIJSMM301D6X55.9.1.A01.1.454.light.4.raw

SEQ ID NO: 589105 - DNA, 501 bp, Homo sapiens; identical to SEQ ID NO: 540528
  misc_feature: HIJSMM301BTAZ6.11.31.C09.1.454.light.4.raw

SEQ ID NO: 589106 - DNA, 483 bp, Homo sapiens; identical to SEQ ID NO: 555750
  misc_feature: HIJSMM301D20XQ.41.78.H01.1.454.light.4.raw

SEQ ID NO: 589107 - DNA, 488 bp, Homo sapiens; identical to SEQ ID NO: 535990
  misc_feature: HIJSMM301B78AV.11.28.C06.1.454.light.4.raw

SEQ ID NO: 589108 - DNA, 512 bp, Homo sapiens; identical to SEQ ID NO: 552719
  misc_feature: HIJSMM301DG1T9.22.36.D03.1.454.light.4.raw

SEQ ID NO: 589109 - DNA, 489 bp, Homo sapiens
  misc_feature: HIJSMM301CZ4L4.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtttccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcacttcggcggagggaccagggtggaggatcagacgaactgtgg

SEQ ID NO: 589110 - DNA, 491 bp, Homo sapiens; identical to SEQ ID NO: 566346
  misc_feature: HIJSMM301AI10G.26.78.H01.1.454.light.4.raw

SEQ ID NO: 589111 - DNA, 486 bp, Homo sapiens
  misc_feature: HIJSMM301CFSFT.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcggccgagggaccgagggtggaaagtcaaacgaactagtggctgcacca

SEQ ID NO: 589112 - DNA, 500 bp, Homo sapiens
  misc_feature: HIJSMM301DGYHM.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcactctgttcccgccctcctccacgagagta

SEQ ID NO: 589113 - DNA, 471 bp, Homo sapiens
  misc_feature: HIJSMM301ALZXH.9.15.B04.1.454.light.4.raw
tgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggagcagctccaacatcgggggagactctgatgcacattggtatcagcagcttccagaagcagcccccaaactcctcatctatgctaacaccaatcggccctcaggggtccctgaccgattctctggctccaagtctggcacctcagcctccctgaccatcagtgaattgcagactgaggatgaggctaactctactgccagtcctcgacagcagcctgggtgtttgggtgttcggcggac

SEQ ID NO: 589114 - DNA, 487 bp, Homo sapiens; identical to SEQ ID NO: 537573
  misc_feature: HIJSMM301CYC68.3.10.A10.1.454.light.4.raw

SEQ ID NO: 589115 - DNA, 504 bp, Homo sapiens
  misc_feature: HIJSMM301A1ARH.43.34.D01.1.454.light.4.raw
  modified_base (360)..(360): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctgctcaagtctggcaacncggcctcctgacaatctctgggcctccgaggctggaggacgaggctgatttattattgctgctcatatgcaggttagttacactttatgtctttcggaagttgggacgacggtcaccgtccgtaggtcagccccaaggcccaaa

SEQ ID NO: 589116 - DNA, 492 bp, Homo sapiens; identical to SEQ ID NO: 544389
  misc_feature: HIJSMM301AYGRJ.22.25.C03.1.454.light.4.raw

SEQ ID NO: 589117 - DNA, 486 bp, Homo sapiens; identical to SEQ ID NO: 535043
  misc_feature: HIJSMM301B9B00.46.35.D02.1.454.light.4.raw

SEQ ID NO: 589118 - DNA, 494 bp, Homo sapiens; identical to SEQ ID NO: 535478
  misc_feature: HIJSMM301BF9W2.10.79.H02.1.454.light.4.raw

SEQ ID NO: 589119 - DNA, 497 bp, Homo sapiens; identical to SEQ ID NO: 535740
  misc_feature: HIJSMM301BMAM1.3.71.G05.1.454.light.4.raw

SEQ ID NO: 589120 - DNA, 491 bp, Homo sapiens
  misc_feature: HIJSMM301CDJZR.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatacaaacgaactgtggctgcaccta

SEQ ID NO: 589121 - DNA, 491 bp, Homo sapiens; identical to SEQ ID NO: 538388
  misc_feature: HIJSMM301B00AJ.51.81.H04.1.454.light.4.raw

SEQ ID NO: 589122 - DNA, 516 bp, Homo sapiens
  misc_feature: HIJSMM301CVHNS.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatatttttgtcaggtgtgggagactaatttggtcatatgttgttcggcggagggaccaagctgaccgtcctcggtcagcccaaggctgccccctcggtcactctgttcccaccctcctc

SEQ ID NO: 589123 - DNA, 487 bp, Homo sapiens
  misc_feature: HIJSMM301AL31T.41.35.D02.1.454.light.4.raw
tctatactatcacgaccggtgctcgatttagcacacgatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 589124 - DNA, 448 bp, Homo sapiens
  misc_feature: HIJSMM301ELT0N.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgcccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 589125 - DNA, 493 bp, Homo sapiens
  misc_feature: HIJSMM301ALNGG.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaatcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtcggagttcaaacgaactgtggctgcacatctgtcttcatt

SEQ ID NO: 589126 - DNA, 485 bp, Homo sapiens; identical to SEQ ID NO: 538533
  misc_feature: HIJSMM301BXBGG.47.78.H01.1.454.light.4.raw

SEQ ID NO: 589127 - DNA, 506 bp, Homo sapiens
  misc_feature: HIJSMM301AVSIX.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttcttgtcacacgtgggacgatgggcgactgcgatcttcggtcgggagggaccgaagctcgaccgtccctgggtcgagcccaacggctcgccccctccggtcact

SEQ ID NO: 589128 - DNA, 516 bp, Homo sapiens
  misc_feature: HIJSMM301BIQJU.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatatatcacccccgtcgttcggcgggggaccgaagctgaccgtcctaggtcagcccaaggctgccccctccggtcactctgttcccaccctcctcagacgtatca

SEQ ID NO: 589129 - DNA, 496 bp, Homo sapiens
  misc_feature: HIJSMM301DEDKO.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggtggggggaccaagctgaccgtcctaggtcagccc

SEQ ID NO: 589130 - DNA, 496 bp, Homo sapiens; identical to SEQ ID NO: 535109
  misc_feature: HIJSMM301B4WRH.16.78.H01.1.454.light.4.raw

SEQ ID NO: 589131 - DNA, 513 bp, Homo sapiens
  misc_feature: HIJSMM301DFI3P.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcgggcggagggaccaagctgaccgtcctaggtcagcccaaggctgccccctcggtcactctgttcccgccctcctctct

SEQ ID NO: 589132 - DNA, 493 bp, Homo sapiens; identical to SEQ ID NO: 536289
  misc_feature: HIJSMM301AQFZ2.14.5.A05.1.454.light.4.raw

SEQ ID NO: 589133 - DNA, 521 bp, Homo sapiens
  misc_feature: HIJSMM301AYCRZ.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgtcg

SEQ ID NO: 589134 - DNA, 498 bp, Homo sapiens; identical to SEQ ID NO: 536173
  misc_feature: HIJSMM301BQ2C1.12.86.H09.1.454.light.4.raw

SEQ ID NO: 589135 - DNA, 484 bp, Homo sapiens; identical to SEQ ID NO: 535400
  misc_feature: HIJSMM301EO42X.46.26.C04.1.454.light.4.raw

SEQ ID NO: 589136 - DNA, 490 bp, Homo sapiens
  misc_feature: HIJSMM301BGGPB.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgctacttttggccaggggaccaaagttgagatcaaacgaactgtggctgcaccatctgtt

SEQ ID NO: 589137 - DNA, 459 bp, Homo sapiens; identical to SEQ ID NO: 542744
  misc_feature: HIJSMM301B9OA5.11.86.H09.1.454.light.4.raw

SEQ ID NO: 589138 - DNA, 444 bp, Homo sapiens
  misc_feature: HIJSMM301CAFQQ.18.9.A09.1.454.light.4.raw
tacgagtatgcacgaccggtgctcgatttagcgagacgcgcagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 589139 - DNA, 486 bp, Homo sapiens; identical to SEQ ID NO: 561506
  misc_feature: HIJSMM301BD941.4.57.F02.1.454.light.4.raw

SEQ ID NO: 589140 - DNA, 481 bp, Homo sapiens; identical to SEQ ID NO: 539249
  misc_feature: HIJSMM301BE1HL.11.76.G10.1.454.light.4.raw

SEQ ID NO: 589141 - DNA, 485 bp, Homo sapiens
  misc_feature: HIJSMM301EHURY.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtcctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 589142 - DNA, 495 bp, Homo sapiens; identical to SEQ ID NO: 535821
  misc_feature: HIJSMM301EZXKO.3.31.C09.1.454.light.4.raw

SEQ ID NO: 589143 - DNA, 494 bp, Homo sapiens; identical to SEQ ID NO: 534992
  misc_feature: HIJSMM301DD9TH.9.1.A01.1.454.light.4.raw

SEQ ID NO: 589144 - DNA, 488 bp, Homo sapiens; identical to SEQ ID NO: 537124
  misc_feature: HIJSMM301APVDC.11.25.C03.1.454.light.4.raw

SEQ ID NO: 589145 - DNA, 478 bp, Homo sapiens
  misc_feature: HIJSMM301DIVB7.40.61.F06.1.454.light.4.raw
tctagcgactcacgaccggtgctcgatttagctacgctctaagggaaaggggcagtcaggacacagcatggacatgagagtcctcgctcagctcctggggctcctgctgctctgtttcccaggtgccagatgtgacatccagatgacccagtctccatcctcactgtctgcatctgtaggagacagagtcaccatcacttgtcgggcgagtcaagacattagcaactacttagcctggtttcagcagaaaccagggaaagcccctaagtccctgatctctgctgcatccaatttgcaaagtggggtcccatcgagattcagcggcagtggatctggaacaaacttcactctcaccatcaacagcctgcagactggagattttggaacttattactgccaacattataatactttccctctcactttcggcggagggaccacggtggagatcagacgaactgtggctgcaccatctgtt

SEQ ID NO: 589146 - DNA, 481 bp, Homo sapiens; identical to SEQ ID NO: 535993
  misc_feature: HIJSMM301EMU20.21.25.C03.1.454.light.4.raw

SEQ ID NO: 589147 - DNA, 503 bp, Homo sapiens; identical to SEQ ID NO: 547049
  misc_feature: HIJSMM301AZP05.18.59.F04.1.454.light.4.raw

SEQ ID NO: 589148 - DNA, 496 bp, Homo sapiens
  misc_feature: HIJSMM301ELLMX.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctcgttcccg

SEQ ID NO: 589149 - DNA, 497 bp, Homo sapiens; identical to SEQ ID NO: 539058
  misc_feature: HIJSMM301BAED7.12.87.H10.1.454.light.4.raw

SEQ ID NO: 589150 - DNA, 521 bp, Homo sapiens
  misc_feature: HIJSMM301DNUIF.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgtttggtcgtctatgatgataccgagcggccctcagggatccctgagcgattctccggctccaactctggtgacacggccaccctgacccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccgccctcctcgagtacg

SEQ ID NO: 589151 - DNA, 518 bp, Homo sapiens; identical to SEQ ID NO: 578902
  misc_feature: HIJSMM301CO8AP.5.27.C05.1.454.light.4.raw

SEQ ID NO: 589152 - DNA, 495 bp, Homo sapiens; identical to SEQ ID NO: 535596
  misc_feature: HIJSMM301DSHJR.10.79.H02.1.454.light.4.raw

SEQ ID NO: 589153 - DNA, 508 bp, Homo sapiens
  misc_feature: HIJSMM301EOX6X.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttccggccctcgggaccaaagtggatatcaaacgaactagtggctgcaccatctgtctt

SEQ ID NO: 589154 - DNA, 492 bp, Homo sapiens; identical to SEQ ID NO: 535126
  misc_feature: HIJSMM301C9CLJ.18.11.A11.1.454.light.4.raw

SEQ ID NO: 589155 - DNA, 506 bp, Homo sapiens
  misc_feature: HIJSMM301AKI0T.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatggcagtggcgtttgggtgttcggcggagggaccaagctgaccgttcg

SEQ ID NO: 589156 - DNA, 481 bp, Homo sapiens
  misc_feature: HIJSMM301CTR4X.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtgggtcctaccaacgttcagcgacagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 589157 - DNA, 483 bp, Homo sapiens
  misc_feature: HIJSMM301DHJSU.51.44.D11.1.454.light.4.raw
cgatcgtatacacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaattgccgggcaagtcagagcattagcaggtatttaaattggtatcagcagaaaccagggaaagcccctaaggtcctgatctatgctgcatccagtttgcaaagtggggtcccatcaaggttcagtggcagtggatctgggacggatttcactctcaccatcagtagtctgcaacctgaagattttgcaacttactactgtcaacagagttacggtacctgctcactttcggcggacgggaccaaggtggagatcaaacgaactgtggctgcacatctgtctt

SEQ ID NO: 589158 - DNA, 487 bp, Homo sapiens; identical to SEQ ID NO: 540841
  misc_feature: HIJSMM301BS56O.4.33.C11.1.454.light.4.raw

SEQ ID NO: 589159 - DNA, 464 bp, Homo sapiens; identical to SEQ ID NO: 539492
  misc_feature: HIJSMM301ED1M5.18.59.F04.1.454.light.4.raw

SEQ ID NO: 589160 - DNA, 506 bp, Homo sapiens
  misc_feature: HIJSMM301CBUZY.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggtttttcggcggagggaccaggctgaccgtcctaagtcagcccaaggctgccccctcggt

SEQ ID NO: 589161 - DNA, 505 bp, Homo sapiens
  misc_feature: HIJSMM301CNC8P.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggttgtgggatagtagtggtgatcatccatacgtcttcggaactgggaccaaggtctccgtcctacgtcagcccaaggccaactccactgtcact

SEQ ID NO: 589162 - DNA, 496 bp, Homo sapiens; identical to SEQ ID NO: 535423
  misc_feature: HIJSMM301BZZZE.3.33.C11.1.454.light.4.raw

SEQ ID NO: 589163 - DNA, 470 bp, Homo sapiens; identical to SEQ ID NO: 550855
  misc_feature: HIJSMM301A4Q7L.3.82.H05.1.454.light.4.raw

SEQ ID NO: 589164 - DNA, 496 bp, Homo sapiens
  misc_feature: HIJSMM301BUK46.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccaggggaccaagctggagatcaaacgaactgtggcctgcaccatctgt

SEQ ID NO: 589165 - DNA, 484 bp, Homo sapiens; identical to SEQ ID NO: 542211
  misc_feature: HIJSMM301B5PSU.13.36.D03.1.454.light.4.raw

SEQ ID NO: 589166 - DNA, 448 bp, Homo sapiens; identical to SEQ ID NO: 538166
  misc_feature: HIJSMM301B5HKG.18.9.A09.1.454.light.4.raw

SEQ ID NO: 589167 - DNA, 496 bp, Homo sapiens
  misc_feature: HIJSMM301AMSR7.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatctcccgccat

SEQ ID NO: 589168 - DNA, 483 bp, Homo sapiens
  misc_feature: HIJSMM301EIAFN.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggcttgcaccatctgtt

SEQ ID NO: 589169 - DNA, 473 bp, Homo sapiens; identical to SEQ ID NO: 546369
  misc_feature: HIJSMM301A1GD6.18.76.G10.1.454.light.4.raw

SEQ ID NO: 589170 - DNA, 501 bp, Homo sapiens
  misc_feature: HIJSMM301C2FX1.41.45.E01.1.454.light.4.raw
tctatactatcacgaccggtgctcgatttagtgagtcagtaagggaaagggggtggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggctgcccctcggtcactc

SEQ ID NO: 589171 - DNA, 466 bp, Homo sapiens; identical to SEQ ID NO: 536398
  misc_feature: HIJSMM301ADJDI.3.20.B09.1.454.light.4.raw

SEQ ID NO: 589172 - DNA, 509 bp, Homo sapiens; identical to SEQ ID NO: 535670
  misc_feature: HIJSMM301C7S1Y.47.23.C01.1.454.light.4.raw

SEQ ID NO: 589173 - DNA, 508 bp, Homo sapiens
  misc_feature: HIJSMM301C261G.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtaggaaatacaaacgaactagtggctgcaccatctgtcttcactcttccccg

SEQ ID NO: 589174 - DNA, 517 bp, Homo sapiens; identical to SEQ ID NO: 538938
  misc_feature: HIJSMM301C0Q02.7.86.H09.1.454.light.4.raw

SEQ ID NO: 589175 - DNA, 485 bp, Homo sapiens; identical to SEQ ID NO: 535501
  misc_feature: HIJSMM301A96OI.3.10.A10.1.454.light.4.raw

SEQ ID NO: 589176 - DNA, 484 bp, Homo sapiens
  misc_feature: HIJSMM301AJZAI.40.83.H06.1.454.light.4.raw
tctagcgactcacgaccggtgctcgatttagatcacgtgcgtcgcgggaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaaactgtccgtcctaggtcagcccaa

SEQ ID NO: 589177 - DNA, 503 bp, Homo sapiens
  misc_feature: HIJSMM301D4IEW.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactccg

SEQ ID NO: 589178 - DNA, 512 bp, Homo sapiens
  misc_feature: HIJSMM301CG4FW.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcctagacgttcggtccaacggaccgaacgtagggaaagtaacaaacgaaacctagtggcgtgcacca

SEQ ID NO: 589179 - DNA, 511 bp, Homo sapiens
  misc_feature: HIJSMM301BNLWZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaatacaaacgtaactacgtggcgtgcaccatcctgtcttcatcttccccg

SEQ ID NO: 589180 - DNA, 503 bp, Homo sapiens
  misc_feature: HIJSMM301CZXZ2.9.53.E09.1.454.light.4.raw
tgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgtccccccg

SEQ ID NO: 589181 - DNA, 509 bp, Homo sapiens; identical to SEQ ID NO: 539359
  misc_feature: HIJSMM301DX6V0.47.85.H08.1.454.light.4.raw

SEQ ID NO: 589182 - DNA, 446 bp, Homo sapiens; identical to SEQ ID NO: 536034
  misc_feature: HIJSMM301DVGSO.18.9.A09.1.454.light.4.raw

SEQ ID NO: 589183 - DNA, 501 bp, Homo sapiens; identical to SEQ ID NO: 536142
  misc_feature: HIJSMM301B4VZY.15.1.A01.1.454.light.4.raw

SEQ ID NO: 589184 - DNA, 483 bp, Homo sapiens
  misc_feature: HIJSMM301ETLCL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaatcccgctcactttcggcggagggaccaaggtggagatcaaacgaa

SEQ ID NO: 589185 - DNA, 484 bp, Homo sapiens; identical to SEQ ID NO: 535441
  misc_feature: HIJSMM301A47E2.26.60.F05.1.454.light.4.raw

SEQ ID NO: 589186 - DNA, 513 bp, Homo sapiens; identical to SEQ ID NO: 542989
  misc_feature: HIJSMM301DTAUD.17.62.F07.1.454.light.4.raw

SEQ ID NO: 589187 - DNA, 493 bp, Homo sapiens; identical to SEQ ID NO: 537912
  misc_feature: HIJSMM301C174R.13.46.E02.1.454.light.4.raw

SEQ ID NO: 589188 - DNA, 489 bp, Homo sapiens; identical to SEQ ID NO: 582386
  misc_feature: HIJSMM301BVXXF.4.59.F04.1.454.light.4.raw

SEQ ID NO: 589189 - DNA, 486 bp, Homo sapiens; identical to SEQ ID NO: 535043
  misc_feature: HIJSMM301BTJ5Q.46.35.D02.1.454.light.4.raw

SEQ ID NO: 589190 - DNA, 498 bp, Homo sapiens
  misc_feature: HIJSMM301DSGD9.4.59.F04.1.454.light.4.raw
agcactgtagcacgaccggtgctcgatttagtacacacacttagggattggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagttttattattgtcaccagttattatagttggcctccgtggacgttcggccaagggaccaaggtaggaaatcaaacgaactgtggctgcaccatctgtctt

SEQ ID NO: 589191 - DNA, 491 bp, Homo sapiens; identical to SEQ ID NO: 542310
  misc_feature: HIJSMM301CEO88.22.65.F10.1.454.light.4.raw

SEQ ID NO: 589192 - DNA, 484 bp, Homo sapiens; identical to SEQ ID NO: 542211
  misc_feature: HIJSMM301B2KAL.13.36.D03.1.454.light.4.raw

SEQ ID NO: 589193 - DNA, 487 bp, Homo sapiens; identical to SEQ ID NO: 536206
  misc_feature: HIJSMM301DHOP2.47.38.D05.1.454.light.4.raw

SEQ ID NO: 589194 - DNA, 486 bp, Homo sapiens; identical to SEQ ID NO: 535385
  misc_feature: HIJSMM301AYC4E.19.71.G05.1.454.light.4.raw

SEQ ID NO: 589195 - DNA, 402 bp, Homo sapiens
  misc_feature: HIJSMM301BJDNE.49.33.C11.1.454.light.4.raw
agtcgagagacacgaccggtgctcgatttagagtgagctcgttgggtttggggagttggtagatgcccctctgggagagatccccaggggtgacagccatggaccctggaagggcctgggctagggacagggaccagagccagtccagggagaggacagagccaatggactggggtgtactgtaacagccctgctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccgcctcctctctctcgact

SEQ ID NO: 589196 - DNA, 490 bp, Homo sapiens; identical to SEQ ID NO: 538999
  misc_feature: HIJSMM301EHYML.16.86.H09.1.454.light.4.raw

SEQ ID NO: 589197 - DNA, 512 bp, Homo sapiens
  misc_feature: HIJSMM301AWVWA.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggaggggaccaagttgaccgtcctaagtcagccaaggctgccccctcggtcactctgttcccgccctcctca

SEQ ID NO: 589198 - DNA, 506 bp, Homo sapiens
  misc_feature: HIJSMM301AVZR1.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtctgggtcagcccaaggctgccccctcggtcactctgttcccg

SEQ ID NO: 589199 - DNA, 531 bp, Homo sapiens
  misc_feature: HIJSMM301B3HHM.3.79.H02.1.454.light.4.raw
  modified_base (423)..(423): a, c, t, g, unknown or other
  modified_base (443)..(443): a, c, t, g, unknown or other
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctnatataacgaaggagccaccnctctcggtgttgtttgggtgggacggaaccgaagtcgtacgaccgtccgtaggtcaccgacccgaacggtctcccgcccccgttcggt

SEQ ID NO: 589200 - DNA, 506 bp, Homo sapiens
  misc_feature: HIJSMM301C0EWA.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgacccatctcggggctccaggctgaggacgaggctgcttattactgcagctcatatacaaggagcaccactctcgtggtatttggtggagggaccaagctgaccgtccaggtcagcccaaggctgccccctcggt

SEQ ID NO: 589201 - DNA, 502 bp, Homo sapiens
  misc_feature: HIJSMM301B23LE.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcattccc

SEQ ID NO: 589202 - DNA, 505 bp, Homo sapiens
  misc_feature: HIJSMM301EX6YB.48.53.E09.1.454.light.4.raw
agtatacatacacgaccggtgctcgatttagagagagtgtgttgggtttgggggctacaacaggcaggcaggggcagcaagatggtgttgcagacccaggtcttcatttctctgttgctctggatctctggtgcctacggggacgtcgtgatgacccagtctccagactccctggcagtgtctctgggcgggaggggccaccgatacgaacgtgacaaaggtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacc

SEQ ID NO: 589203 - DNA, 490 bp, Homo sapiens
  misc_feature: HIJSMM301DB610.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaacgagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccat

SEQ ID NO: 589204 - DNA, 493 bp, Homo sapiens; identical to SEQ ID NO: 544335
  misc_feature: HIJSMM301AZJ0A.5.57.F02.1.454.light.4.raw

SEQ ID NO: 589205 - DNA, 484 bp, Homo sapiens; identical to SEQ ID NO: 535400
  misc_feature: HIJSMM301AZN90.46.26.C04.1.454.light.4.raw

SEQ ID NO: 589206 - DNA, 494 bp, Homo sapiens
  misc_feature: HIJSMM301BY4Z4.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcgggagggaccagggtggaggatcaaacgaactgtggctgcaccatctgtcttcat

SEQ ID NO: 589207 - DNA, 520 bp, Homo sapiens
  misc_feature: HIJSMM301AV737.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttggcggcgggaccaaagtgaccgtcctaagtcagcccaaggctgccccctcggtcactctgttcccgccct

SEQ ID NO: 589208 - DNA, 500 bp, Homo sapiens; identical to SEQ ID NO: 539795
  misc_feature: HIJSMM301DTO1D.22.38.D05.1.454.light.4.raw

SEQ ID NO: 589209 - DNA, 470 bp, Homo sapiens
  misc_feature: HIJSMM301DM3O0.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactatgtcagcaatatgattttgctctccgagtgccacttttggcggggggaccaaggtggacatcaaacgaa

SEQ ID NO: 589210 - DNA, 520 bp, Homo sapiens
  misc_feature: HIJSMM301DD4TQ.17.2.A02.1.454.light.4.raw
  modified_base (474)..(474): a, c, t, g, unknown or other
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtccccgtcttcggaactgggaccaaggtcaccgtcctacgtcacncccaaacggccaaacccccacctcgtcactcttgttccccgccctt

SEQ ID NO: 589211 - DNA, 503 bp, Homo sapiens; identical to SEQ ID NO: 544567
  misc_feature: HIJSMM301ANG2S.41.35.D02.1.454.light.4.raw

SEQ ID NO: 589212 - DNA, 494 bp, Homo sapiens; identical to SEQ ID NO: 535276
  misc_feature: HIJSMM301CNUNY.16.6.A06.1.454.light.4.raw

SEQ ID NO: 589213 - DNA, 488 bp, Homo sapiens
  misc_feature: HIJSMM301EBBIU.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcgggagggaccaaactgtccgtcctaggtcagccccg

SEQ ID NO: 589214 - DNA, 486 bp, Homo sapiens; identical to SEQ ID NO: 535385
  misc_feature: HIJSMM301DSDQ6.19.71.G05.1.454.light.4.raw

SEQ ID NO: 589215 - DNA, 512 bp, Homo sapiens
  misc_feature: HIJSMM301DTZ7I.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaggcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggaggaccaagctgaccgtcttaagtcagcccaaggctgccccctggtcactctgttcccaccctcct

SEQ ID NO: 589216 - DNA, 489 bp, Homo sapiens; identical to SEQ ID NO: 558406
  misc_feature: HIJSMM301DGQE6.19.15.B04.1.454.light.4.raw

SEQ ID NO: 589217 - DNA, 493 bp, Homo sapiens; identical to SEQ ID NO: 538136
  misc_feature: HIJSMM301D19TC.47.64.F09.1.454.light.4.raw

SEQ ID NO: 589218 - DNA, 488 bp, Homo sapiens; identical to SEQ ID NO: 582456
  misc_feature: HIJSMM301B9JS4.47.38.D05.1.454.light.4.raw

SEQ ID NO: 589219 - DNA, 496 bp, Homo sapiens; identical to SEQ ID NO: 573952
  misc_feature: HIJSMM301C35DC.16.78.H01.1.454.light.4.raw

SEQ ID NO: 589220 - DNA, 505 bp, Homo sapiens; identical to SEQ ID NO: 535987
  misc_feature: HIJSMM301AGAEW.18.37.D04.1.454.light.4.raw

SEQ ID NO: 589221 - DNA, 494 bp, Homo sapiens
  misc_feature: HIJSMM301D8UN0.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaagctgaccgtcctaggtcagcccaaggctgccccctcggtcactc

SEQ ID NO: 589222 - DNA, 501 bp, Homo sapiens
  misc_feature: HIJSMM301AP4FP.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaagctgccccctcggtcactctcg

SEQ ID NO: 589223 - DNA, 447 bp, Homo sapiens; identical to SEQ ID NO: 535201
  misc_feature: HIJSMM301EWCIO.18.9.A09.1.454.light.4.raw

SEQ ID NO: 589224 - DNA, 518 bp, Homo sapiens
  misc_feature: HIJSMM301EL57V.22.36.D03.1.454.light.4.raw
acatacgcgtcacgaccggtgctcgatttagctgcgtcacgatctctcttggggggggtcgtcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactcttcg

SEQ ID NO: 589225 - DNA, 491 bp, Homo sapiens
  misc_feature: HIJSMM301AGX2A.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggacttcggtccaagggaccgaaggtaggaagtacaaacgaaactagtggacgtgcaccaa

SEQ ID NO: 589226 - DNA, 509 bp, Homo sapiens
  misc_feature: HIJSMM301BBBVH.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggcctgtccccccg

SEQ ID NO: 589227 - DNA, 481 bp, Homo sapiens
  misc_feature: HIJSMM301CK3DX.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtgctgcaccatctgtt

SEQ ID NO: 589228 - DNA, 497 bp, Homo sapiens
  misc_feature: HIJSMM301AV09A.2.49.E05.1.454.light.4.raw
acgctcgacacacgaccggtgctcgatttagagcgactagcaacacacaaaggggggggaggctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 589229 - DNA, 506 bp, Homo sapiens; identical to SEQ ID NO: 534969
  misc_feature: HIJSMM301EH7F7.18.37.D04.1.454.light.4.raw

SEQ ID NO: 589230 - DNA, 454 bp, Homo sapiens; identical to SEQ ID NO: 536943
  misc_feature: HIJSMM301EZ922.19.86.H09.1.454.light.4.raw

SEQ ID NO: 589231 - DNA, 486 bp, Homo sapiens; identical to SEQ ID NO: 546042
  misc_feature: HIJSMM301DV06L.14.53.E09.1.454.light.4.raw

SEQ ID NO: 589232 - DNA, 482 bp, Homo sapiens
  misc_feature: HIJSMM301EKC40.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggaggaccaagtgcagatcaaacgaactgtggctgca

SEQ ID NO: 589233 - DNA, 495 bp, Homo sapiens; identical to SEQ ID NO: 535596
  misc_feature: HIJSMM301A6W1G.10.79.H02.1.454.light.4.raw

SEQ ID NO: 589234 - DNA, 489 bp, Homo sapiens
  misc_feature: HIJSMM301CWVFS.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtgctgcacatctgtcttcat

SEQ ID NO: 589235 - DNA, 480 bp, Homo sapiens
  misc_feature: HIJSMM301DGQIV.47.62.F07.1.454.light.4.raw
agctcacgtacacgaccggtgctcgatttagtagtcgcataaaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtattttactttcaccatcagcagcctgcagcctgaagatattgcaacatattactgtcaacagtatcataatctccccactttcggccctggaccaagtggatatcaaacgaactgtggctgcacat

SEQ ID NO: 589236 - DNA, 498 bp, Homo sapiens; identical to SEQ ID NO: 535295
  misc_feature: HIJSMM301CG8M6.15.25.C03.1.454.light.4.raw

SEQ ID NO: 589237 - DNA, 454 bp, Homo sapiens; identical to SEQ ID NO: 534964
  misc_feature: HIJSMM301BG5BJ.19.86.H09.1.454.light.4.raw

SEQ ID NO: 589238 - DNA, 506 bp, Homo sapiens
  misc_feature: HIJSMM301BP5HL.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccgaagctgaccgtcctgggtcagcccaaggctgccccctcggtcactc

SEQ ID NO: 589239 - DNA, 486 bp, Homo sapiens; identical to SEQ ID NO: 540314
  misc_feature: HIJSMM301A7E8A.16.53.E09.1.454.light.4.raw

SEQ ID NO: 589240 - DNA, 497 bp, Homo sapiens
  misc_feature: HIJSMM301EHD3N.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgctagtttattactgtcagcagcgtagcaactggcctcggacgttcggccgaagggaccgaaagtaggaacgatacaagcgaacgtgtggcgtgcaccatct

SEQ ID NO: 589241 - DNA, 504 bp, Homo sapiens; identical to SEQ ID NO: 538940
  misc_feature: HIJSMM301AOZS0.2.35.D02.1.454.light.4.raw

SEQ ID NO: 589242 - DNA, 494 bp, Homo sapiens; identical to SEQ ID NO: 535629
  misc_feature: HIJSMM301DRU0M.4.27.C05.1.454.light.4.raw

SEQ ID NO: 589243 - DNA, 510 bp, Homo sapiens; identical to SEQ ID NO: 545115
  misc_feature: HIJSMM301CRLID.19.59.F04.1.454.light.4.raw

SEQ ID NO: 589244 - DNA, 488 bp, Homo sapiens
  misc_feature: HIJSMM301BY5KR.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccagggggaccaaggctggagatcaggcgaac

SEQ ID NO: 589245 - DNA, 502 bp, Homo sapiens; identical to SEQ ID NO: 537363
  misc_feature: HIJSMM301A2J7E.18.23.C01.1.454.light.4.raw

SEQ ID NO: 589246 - DNA, 490 bp, Homo sapiens
  misc_feature: HIJSMM301D2SY9.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaactgtggctgcaccactctgtct

SEQ ID NO: 589247 - DNA, 506 bp, Homo sapiens
  misc_feature: HIJSMM301BRJ9R.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcggggggaccgaagctcgaccgtcctaggtcagcccaaggctcgccccctccggtcta

SEQ ID NO: 589248 - DNA, 509 bp, Homo sapiens
  misc_feature: HIJSMM301B58GQ.43.57.F02.1.454.light.4.raw
tgtgagtagtcacgaccggtgctcgatttagctcgatatagttgggtttgggggctttgcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcgggagggaccgagctcgaccgtcctaggtcacgacccgaaggctccgccccctcggtcacctctcgttccccgccctcctcactactcaca

SEQ ID NO: 589249 - DNA, 444 bp, Homo sapiens; identical to SEQ ID NO: 535594
  misc_feature: HIJSMM301BYVUT.9.9.A09.1.454.light.4.raw

SEQ ID NO: 589250 - DNA, 513 bp, Homo sapiens; identical to SEQ ID NO: 535719
  misc_feature: HIJSMM301DJXDM.17.33.C11.1.454.light.4.raw

SEQ ID NO: 589251 - DNA, 504 bp, Homo sapiens
  misc_feature: HIJSMM301D4VQ2.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcctgggaccaaagtggatatcaaacgaactgtggctgcaccatctgtctt

SEQ ID NO: 589252 - DNA, 490 bp, Homo sapiens
  misc_feature: HIJSMM301B82LJ.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccagggtggaaagtacaaacgaactagtggctacaccatctgtt

SEQ ID NO: 589253 - DNA, 493 bp, Homo sapiens
  misc_feature: HIJSMM301CFPJM.15.59.F04.1.454.light.4.raw
  modified_base (476)..(476): a, c, t, g, unknown or other
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccncctcctcgctacgtaga

SEQ ID NO: 589254 - DNA, 506 bp, Homo sapiens
  misc_feature: HIJSMM301D66CA.48.53.E09.1.454.light.4.raw
agtatacatacacgaccggtgctcgatttagagagagtgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaaacgaactgtggctgcaccatctgtcttcatcttccccg

SEQ ID NO: 589255 - DNA, 502 bp, Homo sapiens; identical to SEQ ID NO: 541971
  misc_feature: HIJSMM301ARBWD.4.39.D06.1.454.light.4.raw

SEQ ID NO: 589256 - DNA, 448 bp, Homo sapiens; identical to SEQ ID NO: 540364
  misc_feature: HIJSMM301CULJ7.18.9.A09.1.454.light.4.raw

SEQ ID NO: 589257 - DNA, 477 bp, Homo sapiens
  misc_feature: HIJSMM301BR044.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgctgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccat

SEQ ID NO: 589258 - DNA, 494 bp, Homo sapiens
  misc_feature: HIJSMM301AXV14.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattataacttcgtggacgttcggccgaaggaccgaaggtaggataatcagacgaaac

SEQ ID NO: 589259 - DNA, 447 bp, Homo sapiens; identical to SEQ ID NO: 535020
  misc_feature: HIJSMM301A8X5C.18.9.A09.1.454.light.4.raw

SEQ ID NO: 589260 - DNA, 520 bp, Homo sapiens; identical to SEQ ID NO: 571628
  misc_feature: HIJSMM301AJ1HH.27.23.C01.1.454.light.4.raw

SEQ ID NO: 589261 - DNA, 496 bp, Homo sapiens; identical to SEQ ID NO: 536248
  misc_feature: HIJSMM301AR2L9.22.27.C05.1.454.light.4.raw

SEQ ID NO: 589262 - DNA, 479 bp, Homo sapiens; identical to SEQ ID NO: 559030
  misc_feature: HIJSMM301A3L07.41.5.A05.1.454.light.4.raw

SEQ ID NO: 589263 - DNA, 482 bp, Homo sapiens; identical to SEQ ID NO: 535216
  misc_feature: HIJSMM301AL2BW.17.26.C04.1.454.light.4.raw

SEQ ID NO: 589264 - DNA, 490 bp, Homo sapiens
  misc_feature: HIJSMM301C1PLP.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcgagggaccaaggtggagatcaaacgaactgtggctgcaccatctgtcttcatcttcccgcta

SEQ ID NO: 589265 - DNA, 494 bp, Homo sapiens; identical to SEQ ID NO: 535629
  misc_feature: HIJSMM301ASGBI.4.27.C05.1.454.light.4.raw

SEQ ID NO: 589266 - DNA, 490 bp, Homo sapiens; identical to SEQ ID NO: 587852
  misc_feature: HIJSMM301EEXY2.10.77.G11.1.454.light.4.raw

SEQ ID NO: 589267 - DNA, 510 bp, Homo sapiens
  misc_feature: HIJSMM301ELYT6.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacagggacagcattatttgggtgttcggcggagggaccaagctgaccgtcctgcgtcagcccaaggctgccccctcggtcact

SEQ ID NO: 589268 - DNA, 494 bp, Homo sapiens; identical to SEQ ID NO: 573994
  misc_feature: HIJSMM301DDORU.22.5.A05.1.454.light.4.raw

SEQ ID NO: 589269 - DNA, 491 bp, Homo sapiens; identical to SEQ ID NO: 535176
  misc_feature: HIJSMM301ASD79.13.39.D06.1.454.light.4.raw

SEQ ID NO: 589270 - DNA, 502 bp, Homo sapiens
  misc_feature: HIJSMM301B7IFA.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtctttcggaattgggacgacggtcaccgtcctaggtcagcccaaggccaaccccac

SEQ ID NO: 589271 - DNA, 505 bp, Homo sapiens; identical to SEQ ID NO: 536117
  misc_feature: HIJSMM301ER15E.8.71.G05.1.454.light.4.raw

SEQ ID NO: 589272 - DNA, 447 bp, Homo sapiens; identical to SEQ ID NO: 535201
  misc_feature: HIJSMM301CZ462.18.9.A09.1.454.light.4.raw

SEQ ID NO: 589273 - DNA, 454 bp, Homo sapiens; identical to SEQ ID NO: 534964
  misc_feature: HIJSMM301A1UYI.19.86.H09.1.454.light.4.raw

SEQ ID NO: 589274 - DNA, 593 bp, Homo sapiens
  misc_feature: HIJSMM301EPMAK.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataactggccctcagggatcccagaccgattctctggctccgactcaggaaagacagcttccctgaccatcactggggctcaggcggaagatgggacgtcgtacgtacttaacttacgtacgtaacccggtacccgggaacgacgacgtaggtcgtcgtaccgaaccggtagggttaggtttacggttccggggacgggggaacccgggaaccccctaccgtaccggtaccgttacggttacggtacgacccgaacccggaacggtccgtcccccggtcccccggttccggta

SEQ ID NO: 589275 - DNA, 504 bp, Homo sapiens; identical to SEQ ID NO: 535561
  misc_feature: HIJSMM301A6Z8U.4.57.F02.1.454.light.4.raw

SEQ ID NO: 589276 - DNA, 486 bp, Homo sapiens
  misc_feature: HIJSMM301DBFRZ.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctctacttcggtcggagggaccaaggtggagatcaaacgaact

SEQ ID NO: 589277 - DNA, 510 bp, Homo sapiens
  misc_feature: HIJSMM301D0ZKF.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagccaaggctgcccctcggtcact

SEQ ID NO: 589278 - DNA, 523 bp, Homo sapiens
  misc_feature: HIJSMM301AUB8L.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatattacaaccagtgacacttgggtgttcggcggagggaccaggctgaccgtcctaggtcagcccaaggctgccccctcggtcactctgttcccaccct

SEQ ID NO: 589279 - DNA, 477 bp, Homo sapiens
  misc_feature: HIJSMM301BJSHH.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactagtggctgcacca

SEQ ID NO: 589280 - DNA, 515 bp, Homo sapiens
  misc_feature: HIJSMM301CQB3D.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 589281 - DNA, 487 bp, Homo sapiens
  misc_feature: HIJSMM301CBBIW.46.26.C04.1.454.light.4.raw
  modified_base (433)..(433): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctntacaagtcccgctcactttcggcggagggaccaaggtggagatcaaacgtaacg

SEQ ID NO: 589282 - DNA, 444 bp, Homo sapiens; identical to SEQ ID NO: 535027
  misc_feature: HIJSMM301DX8YA.8.73.G07.1.454.light.4.raw

SEQ ID NO: 589283 - DNA, 477 bp, Homo sapiens; identical to SEQ ID NO: 572574
  misc_feature: HIJSMM301BXZYI.41.8.A08.1.454.light.4.raw

SEQ ID NO: 589284 - DNA, 504 bp, Homo sapiens
  misc_feature: HIJSMM301AYDOW.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaaggtgaccgtcctaggtcagcccaaggctgcccccc

SEQ ID NO: 589285 - DNA, 504 bp, Homo sapiens; identical to SEQ ID NO: 535561
  misc_feature: HIJSMM301ANR6B.4.57.F02.1.454.light.4.raw

SEQ ID NO: 589286 - DNA, 496 bp, Homo sapiens
  misc_feature: HIJSMM301BFMHK.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggggggaccaaggtggagttcaaacgaaactgtggctgcaccatctgtcttcatt

SEQ ID NO: 589287 - DNA, 488 bp, Homo sapiens; identical to SEQ ID NO: 542175
  misc_feature: HIJSMM301DHB1U.48.27.C05.1.454.light.4.raw

SEQ ID NO: 589288 - DNA, 487 bp, Homo sapiens; identical to SEQ ID NO: 536206
  misc_feature: HIJSMM301EYBTM.47.38.D05.1.454.light.4.raw

SEQ ID NO: 589289 - DNA, 494 bp, Homo sapiens
  misc_feature: HIJSMM301A2D4P.49.6.A06.1.454.light.4.raw
agtcgagagacacgaccggtgctcgatttagatctactgacagggggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattatagctatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctcatatgcaggcagcaacaattttgtgatattcggcggagggaccaagctgaccgtcctaggtcagcccaaggctgccccc

SEQ ID NO: 589290 - DNA, 509 bp, Homo sapiens
  misc_feature: HIJSMM301DBZ22.17.33.C11.1.454.light.4.raw
  modified_base (504)..(504): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttccngccct

SEQ ID NO: 589291 - DNA, 494 bp, Homo sapiens
  misc_feature: HIJSMM301BNN83.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggtccaagggaccagggtaggaaagtacaagcgaaactgtggctgcaccatctgtctt

SEQ ID NO: 589292 - DNA, 486 bp, Homo sapiens; identical to SEQ ID NO: 535043
  misc_feature: HIJSMM301CHTII.46.35.D02.1.454.light.4.raw

SEQ ID NO: 589293 - DNA, 497 bp, Homo sapiens
  misc_feature: HIJSMM301DKDMX.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggccgagctgaccgtcctacgtcagcccaaggctccg

SEQ ID NO: 589294 - DNA, 499 bp, Homo sapiens
  misc_feature: HIJSMM301AI15S.43.34.D01.1.454.light.4.raw
tgtgagtagtcacgaccggtgctcgatttagatcgtctgtgttgagtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccacctgtcactctgttcccaccctcctccactactca

SEQ ID NO: 589295 - DNA, 547 bp, Homo sapiens
  misc_feature: HIJSMM301ECYRN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaacgggaccgaaacgggtagggtaaagtacaaaacggaaacctaggttgggtccgttggccgaacccaacttccttcgttctttctacttcctttccccccgg

SEQ ID NO: 589296 - DNA, 500 bp, Homo sapiens
  misc_feature: HIJSMM301BDYX1.43.62.F07.1.454.light.4.raw
tgtgagtagtcacgaccggtgctcgatttagtagtcgcataaagggaaagggggcaggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtaggaaagcaaacgaactagtggctgcaccatctgtcttcta

SEQ ID NO: 589297 - DNA, 485 bp, Homo sapiens; identical to SEQ ID NO: 535880
  misc_feature: HIJSMM301A8EGV.7.75.G09.1.454.light.4.raw

SEQ ID NO: 589298 - DNA, 505 bp, Homo sapiens; identical to SEQ ID NO: 535503
  misc_feature: HIJSMM301D8S8Y.8.28.C06.1.454.light.4.raw

SEQ ID NO: 589299 - DNA, 497 bp, Homo sapiens; identical to SEQ ID NO: 536371
  misc_feature: HIJSMM301BGHUR.16.78.H01.1.454.light.4.raw

SEQ ID NO: 589300 - DNA, 501 bp, Homo sapiens; identical to SEQ ID NO: 535746
  misc_feature: HIJSMM301A020W.18.11.A11.1.454.light.4.raw

SEQ ID NO: 589301 - DNA, 514 bp, Homo sapiens; identical to SEQ ID NO: 551541
  misc_feature: HIJSMM301B1GLA.41.9.A09.1.454.light.4.raw

SEQ ID NO: 589302 - DNA, 507 bp, Homo sapiens
  misc_feature: HIJSMM301CR7OB.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgtttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggtcggacccagatgactgtcctcagtcagcccaaggctgccccctcggt

SEQ ID NO: 589303 - DNA, 509 bp, Homo sapiens
  misc_feature: HIJSMM301BAFGF.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgtggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttggcggggggaccaagctgaccgtcctaggtcagcccaacggctgtccccccg

SEQ ID NO: 589304 - DNA, 483 bp, Homo sapiens
  misc_feature: HIJSMM301EJQPC.5.40.D07.1.454.light.4.raw
atcagacacgcacgaccggtgctcgatttagtgatagagcgtaacaacagagggtgctcgatttagtgatagagcgtaacaacagaggggggaactgctcagttaggacccagacggaaccatggaagccccagcgcagcttctcttcctcctgctatctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggacc

SEQ ID NO: 589305 - DNA, 521 bp, Homo sapiens; identical to SEQ ID NO: 538715
  misc_feature: HIJSMM301A2G3V.27.23.C01.1.454.light.4.raw

SEQ ID NO: 589306 - DNA, 496 bp, Homo sapiens; identical to SEQ ID NO: 535109
  misc_feature: HIJSMM301CQUP2.16.78.H01.1.454.light.4.raw

SEQ ID NO: 589307 - DNA, 487 bp, Homo sapiens; identical to SEQ ID NO: 558047
  misc_feature: HIJSMM301A42CB.4.26.C04.1.454.light.4.raw

SEQ ID NO: 589308 - DNA, 492 bp, Homo sapiens
  misc_feature: HIJSMM301EJKXP.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttactacttttggccaggggaccaagctggagatcaaacgaactgt

SEQ ID NO: 589309 - DNA, 499 bp, Homo sapiens
  misc_feature: HIJSMM301DL4UA.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctcgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgatttattactgcagctcatatgcagttggttcctctttcaagatattcggcggagggaccaggctgaccgtcctgagtcagcccaaggctg

SEQ ID NO: 589310 - DNA, 491 bp, Homo sapiens; identical to SEQ ID NO: 536211
  misc_feature: HIJSMM301AJMB1.16.53.E09.1.454.light.4.raw

SEQ ID NO: 589311 - DNA, 497 bp, Homo sapiens; identical to SEQ ID NO: 534982
  misc_feature: HIJSMM301A8B1B.26.80.H03.1.454.light.4.raw

SEQ ID NO: 589312 - DNA, 480 bp, Homo sapiens
  misc_feature: HIJSMM301COEX1.48.53.E09.1.454.light.4.raw
agtatacatacacgaccggtgctcgatttagagagagtgtgttgggtttggggtggggagcctagctgtgctgtgggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaaggctgac

SEQ ID NO: 589313 - DNA, 483 bp, Homo sapiens
  misc_feature: HIJSMM301B5UP7.40.83.H06.1.454.light.4.raw
tctagcgactcacgaccggtgctcgatttagatcacgtgcgtcgcgggaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgtgaacacagcctccctgaccatcactggactcaagcctgaggacgaggctgactattactgttcagcatgggacggcagcctcagtgaatgggtgttcggcggagggaccaaactgtccgtcctaggtcagcccaa

SEQ ID NO: 589314 - DNA, 494 bp, Homo sapiens; identical to SEQ ID NO: 557656
  misc_feature: HIJSMM301CCLOG.22.5.A05.1.454.light.4.raw

SEQ ID NO: 589315 - DNA, 479 bp, Homo sapiens; identical to SEQ ID NO: 543959
  misc_feature: HIJSMM301BLMTZ.11.11.A11.1.454.light.4.raw

SEQ ID NO: 589316 - DNA, 420 bp, Homo sapiens
  misc_feature: HIJSMM301D8IG2.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccccactgtcactctgttcccgccctcctccatactcgta

SEQ ID NO: 589317 - DNA, 444 bp, Homo sapiens
  misc_feature: HIJSMM301EFZQL.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccacccttctcagacgtatca

SEQ ID NO: 589318 - DNA, 444 bp, Homo sapiens; identical to SEQ ID NO: 535192
  misc_feature: HIJSMM301ATIHG.5.9.A09.1.454.light.4.raw

SEQ ID NO: 589319 - DNA, 489 bp, Homo sapiens; identical to SEQ ID NO: 542780
  misc_feature: HIJSMM301B7NDP.16.53.E09.1.454.light.4.raw

SEQ ID NO: 589320 - DNA, 494 bp, Homo sapiens; identical to SEQ ID NO: 534994
  misc_feature: HIJSMM301DILR4.27.78.H01.1.454.light.4.raw

SEQ ID NO: 589321 - DNA, 499 bp, Homo sapiens
  misc_feature: HIJSMM301CT3NJ.18.59.F04.1.454.light.4.raw
tacgagtatgcacgaccggtgctcgatttagtacacacacttagggagttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcacgcccaagga

SEQ ID NO: 589322 - DNA, 496 bp, Homo sapiens
  misc_feature: HIJSMM301BTGD5.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccaggtgggaaatcaaacgaactagtggctgcaccatctgtcttcatt

SEQ ID NO: 589323 - DNA, 482 bp, Homo sapiens
  misc_feature: HIJSMM301CP1BN.17.39.D06.1.454.light.4.raw
cgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagtattttgcggtttattactgtcagcagtataatcagtggcctcgtggacgttcggccaaggaccaaggtggaaatcaaacgaactgtgg

SEQ ID NO: 589324 - DNA, 487 bp, Homo sapiens; identical to SEQ ID NO: 562286
  misc_feature: HIJSMM301CWHSO.47.36.D03.1.454.light.4.raw

SEQ ID NO: 589325 - DNA, 501 bp, Homo sapiens; identical to SEQ ID NO: 568432
  misc_feature: HIJSMM301ADN31.2.49.E05.1.454.light.4.raw

SEQ ID NO: 589326 - DNA, 499 bp, Homo sapiens; identical to SEQ ID NO: 536578
  misc_feature: HIJSMM301CGE2F.22.27.C05.1.454.light.4.raw

SEQ ID NO: 589327 - DNA, 488 bp, Homo sapiens
  misc_feature: HIJSMM301DGHIL.43.42.D09.1.454.light.4.raw
tgtgagtagtcacgaccggtgctcgatttagacacatacgcagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcagtgtattactgtcagcagtatggtagctcaccgatcaccttcggccaagggacacgactggagattaaccgaactgtggctgcaccat

SEQ ID NO: 589328 - DNA, 494 bp, Homo sapiens
  misc_feature: HIJSMM301A7N28.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtacttttctccggacacttttggtccgggggaccaagctggagatcaaacgaactgtggctgcaccatctgtcttcta

SEQ ID NO: 589329 - DNA, 489 bp, Homo sapiens; identical to SEQ ID NO: 536013
  misc_feature: HIJSMM301A76ZG.26.23.C01.1.454.light.4.raw

SEQ ID NO: 589330 - DNA, 517 bp, Homo sapiens; identical to SEQ ID NO: 537838
  misc_feature: HIJSMM301A6WP4.7.86.H09.1.454.light.4.raw

SEQ ID NO: 589331 - DNA, 501 bp, Homo sapiens
  misc_feature: HIJSMM301CJ4P8.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcgggggaccgacactgaccgtcctaggtcagccaaggctcgcccctccggtcactctcgttcccaccctcctccactactatg

SEQ ID NO: 589332 - DNA, 485 bp, Homo sapiens
  misc_feature: HIJSMM301CF50B.41.33.C11.1.454.light.4.raw
tctatactatcacgaccggtgctcgatttagagtgagctcgttgggtttggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaacgaactgtggctgcacc

SEQ ID NO: 589333 - DNA, 378 bp, Homo sapiens; identical to SEQ ID NO: 547290
  misc_feature: HIJSMM301A0OD3.40.9.A09.1.454.light.4.raw

SEQ ID NO: 589334 - DNA, 473 bp, Homo sapiens
  misc_feature: HIJSMM301E11AO.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagtggcagtggatctgggacagagttcactctcaccatcagcagcctgcagcctgaagatgttgcaacttattactgtcaaaagtataacagtgcccccttcaccttcggccaagggacacgactggagattagacg

SEQ ID NO: 589335 - DNA, 495 bp, Homo sapiens; identical to SEQ ID NO: 551380
  misc_feature: HIJSMM301ATVYP.51.5.A05.1.454.light.4.raw

SEQ ID NO: 589336 - DNA, 474 bp, Homo sapiens
  misc_feature: HIJSMM301CK2PJ.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttctatcttcccgccatctgagacacgcgag

SEQ ID NO: 589337 - DNA, 494 bp, Homo sapiens; identical to SEQ ID NO: 584627
  misc_feature: HIJSMM301BAVFT.43.29.C07.1.454.light.4.raw

SEQ ID NO: 589338 - DNA, 489 bp, Homo sapiens; identical to SEQ ID NO: 535139
  misc_feature: HIJSMM301DVOA1.14.55.E11.1.454.light.4.raw

SEQ ID NO: 589339 - DNA, 448 bp, Homo sapiens; identical to SEQ ID NO: 540364
  misc_feature: HIJSMM301A9O0V.18.9.A09.1.454.light.4.raw

SEQ ID NO: 589340 - DNA, 463 bp, Homo sapiens; identical to SEQ ID NO: 535062
  misc_feature: HIJSMM301BOWZJ.11.73.G07.1.454.light.4.raw

SEQ ID NO: 589341 - DNA, 446 bp, Homo sapiens
  misc_feature: HIJSMM301DN3YF.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 589342 - DNA, 498 bp, Homo sapiens; identical to SEQ ID NO: 571676
  misc_feature: HIJSMM301CLKMR.10.64.F09.1.454.light.4.raw

SEQ ID NO: 589343 - DNA, 486 bp, Homo sapiens; identical to SEQ ID NO: 537310
  misc_feature: HIJSMM301D2HYN.15.28.C06.1.454.light.4.raw

SEQ ID NO: 589344 - DNA, 513 bp, Homo sapiens
  misc_feature: HIJSMM301AXULS.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttccccg

SEQ ID NO: 589345 - DNA, 488 bp, Homo sapiens; identical to SEQ ID NO: 537260
  misc_feature: HIJSMM301C7Z8J.47.70.G04.1.454.light.4.raw

SEQ ID NO: 589346 - DNA, 441 bp, Homo sapiens; identical to SEQ ID NO: 534971
  misc_feature: HIJSMM301ECRC8.11.3.A03.1.454.light.4.raw

SEQ ID NO: 589347 - DNA, 504 bp, Homo sapiens
  misc_feature: HIJSMM301DZHWC.51.59.F04.1.454.light.4.raw
cgatcgtatacacgaccggtgctcgatttagtacacacacttagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 589348 - DNA, 504 bp, Homo sapiens; identical to SEQ ID NO: 538940
  misc_feature: HIJSMM301EW30Y.2.35.D02.1.454.light.4.raw

SEQ ID NO: 589349 - DNA, 504 bp, Homo sapiens; identical to SEQ ID NO: 539690
  misc_feature: HIJSMM301A8Z59.47.65.F10.1.454.light.4.raw

SEQ ID NO: 589350 - DNA, 492 bp, Homo sapiens
  misc_feature: HIJSMM301A7Q96.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacgaactgtggctgcaccatctgt

SEQ ID NO: 589351 - DNA, 489 bp, Homo sapiens; identical to SEQ ID NO: 537328
  misc_feature: HIJSMM301CAE5Y.13.5.A05.1.454.light.4.raw

SEQ ID NO: 589352 - DNA, 490 bp, Homo sapiens
  misc_feature: HIJSMM301BQZZR.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggcctaggggacccaagctggagatcaggcgtaacg

SEQ ID NO: 589353 - DNA, 489 bp, Homo sapiens; identical to SEQ ID NO: 582386
  misc_feature: HIJSMM301DWARC.4.59.F04.1.454.light.4.raw

SEQ ID NO: 589354 - DNA, 513 bp, Homo sapiens
  misc_feature: HIJSMM301AKPVC.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggcccaaccccactgtcactcttcg

SEQ ID NO: 589355 - DNA, 495 bp, Homo sapiens
  misc_feature: HIJSMM301E1LC4.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaaatcaacagagtggaggctgaggatgttggggtttattactgcatgcaagctctacaaactccctcaacgttcggcggagggaccaaggtggagatcaaacgaactgtggctgcaccatctgtcttcta

SEQ ID NO: 589356 - DNA, 510 bp, Homo sapiens
  misc_feature: HIJSMM301DMJ9B.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtctaggtcagcccaaggctgccccctcggtcact

SEQ ID NO: 589357 - DNA, 487 bp, Homo sapiens
  misc_feature: HIJSMM301CLQOJ.10.28.C06.1.454.light.4.raw
catagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttcagggtccagctctggggctgagcgctacctcaccatctccagcctccagtctgaggatgaggctgactattactgtcagacctggggcactggttatgttggttttcggcggagggaccaaggctgaccgtctaggtcagcccaaggctccg

SEQ ID NO: 589358 - DNA, 496 bp, Homo sapiens
  misc_feature: HIJSMM301AXSQW.10.79.H02.1.454.light.4.raw
catagtagtgcacgaccggtgctcgatttagtgtcacacgaaggggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 589359 - DNA, 509 bp, Homo sapiens
  misc_feature: HIJSMM301BSIG7.12.28.C06.1.454.light.4.raw
  modified_base (492)..(492): a, c, t, g, unknown or other
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccgacgggaccgacacgtagaatagagagaactagtggcgtgcaccactctntcgttctatcttcccgt

SEQ ID NO: 589360 - DNA, 446 bp, Homo sapiens
  misc_feature: HIJSMM301BYGXX.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccaaggccaacccctctgtcactctgttcccaccctcctccatactcgta

SEQ ID NO: 589361 - DNA, 508 bp, Homo sapiens
  misc_feature: HIJSMM301BRECD.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggtcatttcggtgttcggcggagggacccaggtgaccgtcctacgtcagccc

SEQ ID NO: 589362 - DNA, 505 bp, Homo sapiens; identical to SEQ ID NO: 539292
  misc_feature: HIJSMM301DCO4S.19.85.H08.1.454.light.4.raw

SEQ ID NO: 589363 - DNA, 507 bp, Homo sapiens
  misc_feature: HIJSMM301EBOUC.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtcgaccgtcctaggtcagcccaaggcctgtccccccg

SEQ ID NO: 589364 - DNA, 506 bp, Homo sapiens
  misc_feature: HIJSMM301CQ22A.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtctacc

SEQ ID NO: 589365 - DNA, 497 bp, Homo sapiens; identical to SEQ ID NO: 548828
  misc_feature: HIJSMM301B28YA.9.39.D06.1.454.light.4.raw

SEQ ID NO: 589366 - DNA, 514 bp, Homo sapiens; identical to SEQ ID NO: 545978
  misc_feature: HIJSMM301AL1JG.17.33.C11.1.454.light.4.raw

SEQ ID NO: 589367 - DNA, 493 bp, Homo sapiens
  misc_feature: HIJSMM301CUW8X.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaacttattactgccaacagtatcatcatcattgtatttcggtggagggaccaaggtggaggtcaaacgaactgtggctgcaccatctgtcttcattcc

SEQ ID NO: 589368 - DNA, 486 bp, Homo sapiens
  misc_feature: HIJSMM301BG3NE.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccagggaccaaactggacatacaaacgaactgtggctgcaccatctgt

SEQ ID NO: 589369 - DNA, 496 bp, Homo sapiens; identical to SEQ ID NO: 541091
  misc_feature: HIJSMM301CU7S2.22.9.A09.1.454.light.4.raw

SEQ ID NO: 589370 - DNA, 443 bp, Homo sapiens; identical to SEQ ID NO: 543161
  misc_feature: HIJSMM301DPXZE.5.9.A09.1.454.light.4.raw

SEQ ID NO: 589371 - DNA, 418 bp, Homo sapiens
  misc_feature: HIJSMM301DWGK2.41.9.A09.1.454.light.4.raw
tctatactatcacgaccggtgctcgatttagcgagacgcgcagggcacgaccggtgctcgatttagatcgtctgtgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 589372 - DNA, 508 bp, Homo sapiens; identical to SEQ ID NO: 560515
  misc_feature: HIJSMM301DR1MM.17.33.C11.1.454.light.4.raw

SEQ ID NO: 589373 - DNA, 478 bp, Homo sapiens; identical to SEQ ID NO: 555043
  misc_feature: HIJSMM301ARZJC.52.1.A01.1.454.light.4.raw

SEQ ID NO: 589374 - DNA, 488 bp, Homo sapiens
  misc_feature: HIJSMM301DINBS.46.26.C04.1.454.light.4.raw
actagcagtacacgaccggtgctcgatttagtctagcgactttgggtttggggtgatcaggactcctcagttcaccttctcacaatggggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgt

SEQ ID NO: 589375 - DNA, 513 bp, Homo sapiens; identical to SEQ ID NO: 568189
  misc_feature: HIJSMM301AZRVT.14.7.A07.1.454.light.4.raw

SEQ ID NO: 589376 - DNA, 492 bp, Homo sapiens
  misc_feature: HIJSMM301A4UHJ.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaactgaccgtcctaggtcacgccaacggct

SEQ ID NO: 589377 - DNA, 503 bp, Homo sapiens
  misc_feature: HIJSMM301CYK9V.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagaggatcaaaggaactagtggctgcaccatctgtcttcatcttcccgccc

SEQ ID NO: 589378 - DNA, 495 bp, Homo sapiens
  misc_feature: HIJSMM301CO8YH.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactcgtggctgcaccatctgtt

SEQ ID NO: 589379 - DNA, 520 bp, Homo sapiens; identical to SEQ ID NO: 538428
  misc_feature: HIJSMM301C0TPC.5.27.C05.1.454.light.4.raw

SEQ ID NO: 589380 - DNA, 487 bp, Homo sapiens; identical to SEQ ID NO: 537079
  misc_feature: HIJSMM301EX95K.14.55.E11.1.454.light.4.raw

SEQ ID NO: 589381 - DNA, 516 bp, Homo sapiens; identical to SEQ ID NO: 537036
  misc_feature: HIJSMM301EXNFB.19.80.H03.1.454.light.4.raw

SEQ ID NO: 589382 - DNA, 489 bp, Homo sapiens; identical to SEQ ID NO: 535139
  misc_feature: HIJSMM301BT3UX.14.55.E11.1.454.light.4.raw

SEQ ID NO: 589383 - DNA, 489 bp, Homo sapiens; identical to SEQ ID NO: 546040
  misc_feature: HIJSMM301B8FPS.11.12.B01.1.454.light.4.raw

SEQ ID NO: 589384 - DNA, 505 bp, Homo sapiens; identical to SEQ ID NO: 535503
  misc_feature: HIJSMM301B50X2.8.28.C06.1.454.light.4.raw

SEQ ID NO: 589385 - DNA, 495 bp, Homo sapiens; identical to SEQ ID NO: 554164
  misc_feature: HIJSMM301BUBBW.27.78.H01.1.454.light.4.raw

SEQ ID NO: 589386 - DNA, 498 bp, Homo sapiens
  misc_feature: HIJSMM301DFUOG.43.27.C05.1.454.light.4.raw
tgtgagtagtcacgaccggtgctcgatttagacgcgatcgaagggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacgacggtcactgtcctaggtcagcccaaggcccaacccc

SEQ ID NO: 589387 - DNA, 511 bp, Homo sapiens
  misc_feature: HIJSMM301AE42N.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtggttcggcggagggaccaggctgaccgtcctaagtcagcccaaggctgccccctcc

SEQ ID NO: 589388 - DNA, 510 bp, Homo sapiens
  misc_feature: HIJSMM301B3XG2.12.67.G01.1.454.light.4.raw
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggt

SEQ ID NO: 589389 - DNA, 507 bp, Homo sapiens
  misc_feature: HIJSMM301B967P.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactgtggctgcaccatctgtcttcat

SEQ ID NO: 589390 - DNA, 498 bp, Homo sapiens
  misc_feature: HIJSMM301CRSZQ.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgattaatttccctccgtggacgttcggccaagggaccaaggagcaaatcaaacgaactgtggctgcaccatctgtcttcatcttcccgccat

SEQ ID NO: 589391 - DNA, 483 bp, Homo sapiens
  misc_feature: HIJSMM301BATXC.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtctaggtcagcccaaggctgcccccc

SEQ ID NO: 589392 - DNA, 510 bp, Homo sapiens
  misc_feature: HIJSMM301C6UBQ.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagcccaccctggccatcagtgggctccggcccgaggatgaggctgattattactgtgtaggttgggatcgcagcctgactgcttacgtcttcggagctgggaccaaggtcaccgtcctaggtcagcccaaggcccaacccac

SEQ ID NO: 589393 - DNA, 487 bp, Homo sapiens
  misc_feature: HIJSMM301EN5F5.49.59.F04.1.454.light.4.raw
agtcgagagacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccagggaccaagctgagatcaaacgaaactgtggctgcaccatctgt

SEQ ID NO: 589394 - DNA, 499 bp, Homo sapiens; identical to SEQ ID NO: 551975
  misc_feature: HIJSMM301AGCN6.41.45.E01.1.454.light.4.raw

SEQ ID NO: 589395 - DNA, 515 bp, Homo sapiens
  misc_feature: HIJSMM301APP75.19.72.G06.1.454.light.4.raw
tactctcgtgcacgaccggtgctcgatttagctacgactgcaagggaaaggggggggtcggcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtggtgcggcggaggggaccaaggtggaccgtccctgggtcagcccaaggctgccccctccggtcacct

SEQ ID NO: 589396 - DNA, 504 bp, Homo sapiens; identical to SEQ ID NO: 551974
  misc_feature: HIJSMM301ETNFU.19.78.H01.1.454.light.4.raw

SEQ ID NO: 589397 - DNA, 495 bp, Homo sapiens
  misc_feature: HIJSMM301B8W3M.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatcctgtctt

SEQ ID NO: 589398 - DNA, 507 bp, Homo sapiens
  misc_feature: HIJSMM301DKNU6.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgc

SEQ ID NO: 589399 - DNA, 488 bp, Homo sapiens; identical to SEQ ID NO: 536547
  misc_feature: HIJSMM301DI94X.15.49.E05.1.454.light.4.raw

SEQ ID NO: 589400 - DNA, 496 bp, Homo sapiens; identical to SEQ ID NO: 537925
  misc_feature: HIJSMM301B5D0P.22.14.B03.1.454.light.4.raw

SEQ ID NO: 589401 - DNA, 478 bp, Homo sapiens
  misc_feature: HIJSMM301BSV2M.40.59.F04.1.454.light.4.raw
tctagcgactcacgaccggtgctcgatttagtacacacacttagggattgggggggccgtcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtgggttttcggtcggagggaccaagctgaccgtcctaagtcagccc

SEQ ID NO: 589402 - DNA, 472 bp, Homo sapiens; identical to SEQ ID NO: 580496
  misc_feature: HIJSMM301EFRQY.13.76.G10.1.454.light.4.raw

SEQ ID NO: 589403 - DNA, 490 bp, Homo sapiens
  misc_feature: HIJSMM301A3JIN.27.78.H01.1.454.light.4.raw
  modified_base (458)..(458): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcactcgccaaggacacgactgganattaaacgaactgtggctgcaccatctgtctt

SEQ ID NO: 589404 - DNA, 493 bp, Homo sapiens; identical to SEQ ID NO: 544835
  misc_feature: HIJSMM301BFG79.43.29.C07.1.454.light.4.raw

SEQ ID NO: 589405 - DNA, 504 bp, Homo sapiens; identical to SEQ ID NO: 560645
  misc_feature: HIJSMM301AX2BT.40.67.G01.1.454.light.4.raw

SEQ ID NO: 589406 - DNA, 507 bp, Homo sapiens
  misc_feature: HIJSMM301CP5AR.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctgttcccc

SEQ ID NO: 589407 - DNA, 512 bp, Homo sapiens; identical to SEQ ID NO: 542831
  misc_feature: HIJSMM301BQGN0.43.19.B08.1.454.light.4.raw

SEQ ID NO: 589408 - DNA, 492 bp, Homo sapiens; identical to SEQ ID NO: 558121
  misc_feature: HIJSMM301EIPLH.9.34.D01.1.454.light.4.raw

SEQ ID NO: 589409 - DNA, 447 bp, Homo sapiens
  misc_feature: HIJSMM301BJF88.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagtctgagtggttctatgtcttcggatctgggaccaaggtcaccgtcctaagtcagcccaaggccaacccctctgtcactctcgttcccaccctcctccatactcgta

SEQ ID NO: 589410 - DNA, 497 bp, Homo sapiens; identical to SEQ ID NO: 535286
  misc_feature: HIJSMM301E0104.18.59.F04.1.454.light.4.raw

SEQ ID NO: 589411 - DNA, 486 bp, Homo sapiens; identical to SEQ ID NO: 544336
  misc_feature: HIJSMM301AY4AZ.12.88.H11.1.454.light.4.raw

SEQ ID NO: 589412 - DNA, 477 bp, Homo sapiens
  misc_feature: HIJSMM301APE7X.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcacagagttacagtaccccgtggacgttcggccaaggaccaaggtggaaatacaaacgaactagtggctgca

SEQ ID NO: 589413 - DNA, 513 bp, Homo sapiens; identical to SEQ ID NO: 543313
  misc_feature: HIJSMM301BYPUE.22.36.D03.1.454.light.4.raw

SEQ ID NO: 589414 - DNA, 486 bp, Homo sapiens
  misc_feature: HIJSMM301AZXPC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccgaagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 589415 - DNA, 498 bp, Homo sapiens
  misc_feature: HIJSMM301DYP6Z.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtactacttttggccaggggaccaagctggagatcaaacgaactgtggctgcaccatctgtt

SEQ ID NO: 589416 - DNA, 507 bp, Homo sapiens
  misc_feature: HIJSMM301BOVUJ.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcta

SEQ ID NO: 589417 - DNA, 504 bp, Homo sapiens; identical to SEQ ID NO: 544267
  misc_feature: HIJSMM301BE0X2.19.85.H08.1.454.light.4.raw

SEQ ID NO: 589418 - DNA, 478 bp, Homo sapiens; identical to SEQ ID NO: 564743
  misc_feature: HIJSMM301C1CMJ.10.74.G08.1.454.light.4.raw

SEQ ID NO: 589419 - DNA, 495 bp, Homo sapiens
  misc_feature: HIJSMM301EAT0H.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgacttgggttttattcactttcggcccttgggaccaaagtggatttcagacgaactgtggctgcaccatctgtcttcta

SEQ ID NO: 589420 - DNA, 456 bp, Homo sapiens
  misc_feature: HIJSMM301EEND4.19.86.H09.1.454.light.4.raw
tactctcgtgcacgaccggtgctcgatttagtgctatagacttggggtttgggggccgttcctgggcccagtctgtgctgactcaggccaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 589421 - DNA, 486 bp, Homo sapiens; identical to SEQ ID NO: 536329
  misc_feature: HIJSMM301EN0MV.21.4.A04.1.454.light.4.raw

SEQ ID NO: 589422 - DNA, 489 bp, Homo sapiens; identical to SEQ ID NO: 546040
  misc_feature: HIJSMM301DHFWP.11.12.B01.1.454.light.4.raw

SEQ ID NO: 589423 - DNA, 447 bp, Homo sapiens; identical to SEQ ID NO: 535020
  misc_feature: HIJSMM301B7O0K.18.9.A09.1.454.light.4.raw

SEQ ID NO: 589424 - DNA, 489 bp, Homo sapiens
  misc_feature: HIJSMM301BUVWE.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcgacagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaactgt

SEQ ID NO: 589425 - DNA, 508 bp, Homo sapiens
  misc_feature: HIJSMM301DLHGD.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctcctgaccatcagtgggctccggtccgaggatgaggctgattattactgtgcaccgtgggatgacatcctgaatgggtccggtgttcggcggagggaccaggctgccgtctaacgtcagcccaaggctgccccctc

SEQ ID NO: 589426 - DNA, 476 bp, Homo sapiens; identical to SEQ ID NO: 538611
  misc_feature: HIJSMM301AGAAW.7.81.H04.1.454.light.4.raw

SEQ ID NO: 589427 - DNA, 491 bp, Homo sapiens
  misc_feature: HIJSMM301DTK2F.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccgaaggtggaagtcaagcgaaactgtggctgcaccatctgtt

SEQ ID NO: 589428 - DNA, 505 bp, Homo sapiens; identical to SEQ ID NO: 578790
  misc_feature: HIJSMM301AFX7V.15.66.F11.1.454.light.4.raw

SEQ ID NO: 589429 - DNA, 495 bp, Homo sapiens; identical to SEQ ID NO: 542410
  misc_feature: HIJSMM301BNVMG.26.12.B01.1.454.light.4.raw

SEQ ID NO: 589430 - DNA, 460 bp, Homo sapiens
  misc_feature: HIJSMM301CGK5U.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactatgttcccaccctcctcacgcgtatgt

SEQ ID NO: 589431 - DNA, 496 bp, Homo sapiens
  misc_feature: HIJSMM301A28XB.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaaccca

SEQ ID NO: 589432 - DNA, 508 bp, Homo sapiens
  misc_feature: HIJSMM301BWVO7.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctctggctccctccttgggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgttcccg

SEQ ID NO: 589433 - DNA, 472 bp, Homo sapiens; identical to SEQ ID NO: 535898
  misc_feature: HIJSMM301CDKAY.15.8.A08.1.454.light.4.raw

SEQ ID NO: 589434 - DNA, 483 bp, Homo sapiens; identical to SEQ ID NO: 542200
  misc_feature: HIJSMM301DDPIN.7.75.G09.1.454.light.4.raw

SEQ ID NO: 589435 - DNA, 476 bp, Homo sapiens; identical to SEQ ID NO: 538026
  misc_feature: HIJSMM301BIQ7P.13.76.G10.1.454.light.4.raw

SEQ ID NO: 589436 - DNA, 503 bp, Homo sapiens; identical to SEQ ID NO: 543938
  misc_feature: HIJSMM301DYPY1.4.71.G05.1.454.light.4.raw

SEQ ID NO: 589437 - DNA, 498 bp, Homo sapiens
  misc_feature: HIJSMM301A8MG6.48.84.H07.1.454.light.4.raw
agtatacatacacgaccggtgctcgatttagcagacgtctgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgtcccg

SEQ ID NO: 589438 - DNA, 513 bp, Homo sapiens; identical to SEQ ID NO: 539258
  misc_feature: HIJSMM301BIUBL.43.19.B08.1.454.light.4.raw

SEQ ID NO: 589439 - DNA, 503 bp, Homo sapiens
  misc_feature: HIJSMM301AUZAH.15.37.D04.1.454.light.4.raw
tctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgattttgcaacttattactgccaacactatgatactccacccgtactactttggccaggggaccaagctggagatacaaaggaactgtggctgcaccatctgtcttcatcttcccg

SEQ ID NO: 589440 - DNA, 447 bp, Homo sapiens; identical to SEQ ID NO: 535020
  misc_feature: HIJSMM301B25RE.18.9.A09.1.454.light.4.raw

SEQ ID NO: 589441 - DNA, 500 bp, Homo sapiens; identical to SEQ ID NO: 567552
  misc_feature: HIJSMM301EJ7XG.5.24.C02.1.454.light.4.raw

SEQ ID NO: 589442 - DNA, 490 bp, Homo sapiens; identical to SEQ ID NO: 547085
  misc_feature: HIJSMM301B10VL.12.51.E07.1.454.light.4.raw

SEQ ID NO: 589443 - DNA, 504 bp, Homo sapiens; identical to SEQ ID NO: 535128
  misc_feature: HIJSMM301DI4QQ.19.85.H08.1.454.light.4.raw

SEQ ID NO: 589444 - DNA, 494 bp, Homo sapiens; identical to SEQ ID NO: 543247
  misc_feature: HIJSMM301BUB7U.22.57.F02.1.454.light.4.raw

SEQ ID NO: 589445 - DNA, 518 bp, Homo sapiens
  misc_feature: HIJSMM301A3RB4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaacaagaactacttagcttggtatcagcagaaaccaggacagcctcctaaactgctcattaactgggcatctacccggcaatcccggggtccctgaccgattcagtggcagcgggtctgggacagatttcactctcaccatcagcagcctgcaggctgaagatgtggctagttttattactgtcaactagtttttctcggggcgttcggccgaagggaccgaagggtaggaaagtacaaaacgaaactgtggctgcaccatctgtcttcatccttccccg

SEQ ID NO: 589446 - DNA, 488 bp, Homo sapiens; identical to SEQ ID NO: 535081
  misc_feature: HIJSMM301DHPGK.26.23.C01.1.454.light.4.raw

SEQ ID NO: 589447 - DNA, 500 bp, Homo sapiens
  misc_feature: HIJSMM301AJ83E.3.33.C11.1.454.light.4.raw
agacgcactccacgaccggtgctcgatttagagtgagctcgttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccccg

SEQ ID NO: 589448 - DNA, 484 bp, Homo sapiens; identical to SEQ ID NO: 538094
  misc_feature: HIJSMM301DC1TJ.3.10.A10.1.454.light.4.raw

SEQ ID NO: 589449 - DNA, 473 bp, Homo sapiens; identical to SEQ ID NO: 546369
  misc_feature: HIJSMM301C98EG.18.76.G10.1.454.light.4.raw

SEQ ID NO: 589450 - DNA, 480 bp, Homo sapiens
  misc_feature: HIJSMM301DU0RE.41.5.A05.1.454.light.4.raw
tctatactatcacgaccggtgctcgatttagatagatagacagggcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaaggga

SEQ ID NO: 589451 - DNA, 491 bp, Homo sapiens; identical to SEQ ID NO: 544714
  misc_feature: HIJSMM301D5YRE.18.11.A11.1.454.light.4.raw

SEQ ID NO: 589452 - DNA, 506 bp, Homo sapiens
  misc_feature: HIJSMM301EAY9C.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccgaagctgaccgtcctaggtcagcccaaggctgcccccg

SEQ ID NO: 589453 - DNA, 502 bp, Homo sapiens
  misc_feature: HIJSMM301CGVHU.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccacttcggccctgggaccaaattgagatcaaacgaactgtggctgcaccatctgtcttcatcttcccgcc

SEQ ID NO: 589454 - DNA, 520 bp, Homo sapiens; identical to SEQ ID NO: 537173
  misc_feature: HIJSMM301CY1H5.27.23.C01.1.454.light.4.raw

SEQ ID NO: 589455 - DNA, 514 bp, Homo sapiens
  misc_feature: HIJSMM301EK8D0.52.34.D01.1.454.light.4.raw
cgcagtacgacacgaccggtgctcgatttagatcgtctgtgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtcctacgtcagcccaaggctgccccctcggtcact

SEQ ID NO: 589456 - DNA, 508 bp, Homo sapiens
  misc_feature: HIJSMM301D7OEK.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcccggtcactccg

SEQ ID NO: 589457 - DNA, 499 bp, Homo sapiens
  misc_feature: HIJSMM301C4HM7.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtccgtgggtcagcccaaggcctgccccctcggtcacttcc

SEQ ID NO: 589458 - DNA, 510 bp, Homo sapiens
  misc_feature: HIJSMM301DSKDE.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaacttgagatcaaacgaactagtggctgcaccatctgtcttcatcttcccgtccact

SEQ ID NO: 589459 - DNA, 502 bp, Homo sapiens; identical to SEQ ID NO: 541501
  misc_feature: HIJSMM301AVCGV.17.27.C05.1.454.light.4.raw

SEQ ID NO: 589460 - DNA, 487 bp, Homo sapiens; identical to SEQ ID NO: 581369
  misc_feature: HIJSMM301AT3DX.7.85.H08.1.454.light.4.raw

SEQ ID NO: 589461 - DNA, 502 bp, Homo sapiens; identical to SEQ ID NO: 541971
  misc_feature: HIJSMM301AN0A2.4.39.D06.1.454.light.4.raw

SEQ ID NO: 589462 - DNA, 497 bp, Homo sapiens; identical to SEQ ID NO: 535664
  misc_feature: HIJSMM301EZSL1.22.14.B03.1.454.light.4.raw

SEQ ID NO: 589463 - DNA, 505 bp, Homo sapiens; identical to SEQ ID NO: 535503
  misc_feature: HIJSMM301DOOV0.8.28.C06.1.454.light.4.raw

SEQ ID NO: 589464 - DNA, 494 bp, Homo sapiens; identical to SEQ ID NO: 536477
  misc_feature: HIJSMM301AVNBA.22.5.A05.1.454.light.4.raw

SEQ ID NO: 589465 - DNA, 526 bp, Homo sapiens
  misc_feature: HIJSMM301CF8RM.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagttttcagtgtccccccggacgttcgtccgcgggaccgaccgacgtaggaaaatagtaagacggaacgtaacgtgggcgttgcgaccaatcctgtcttctactcttcccgt

SEQ ID NO: 589466 - DNA, 602 bp, Homo sapiens
  misc_feature: HIJSMM301ALVVC.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgggagctagtatttacttacgtcgacgacgtcctaccaactagtcgacgtacgtacgtaaacgttaaacttaacgggtttttccgggggttttccgggacggggaaccggggaaccgaacgtcgtacggtacccgttaacctaacgtacgaccgaaccggaacggccgtcccgtcccccgttccggtacctaccttcgtttccccg

SEQ ID NO: 589467 - DNA, 492 bp, Homo sapiens
  misc_feature: HIJSMM301EOQTH.14.55.E11.1.454.light.4.raw
  modified_base (388)..(388): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttnccaaacttactactgtcaacagagttacacgtacccccctcactttcggcggagggaccaaggacggagatcagacgaactgtggctgcaccatctgtcttcta

SEQ ID NO: 589468 - DNA, 505 bp, Homo sapiens
  misc_feature: HIJSMM301DXH1Z.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagactccctggcctgcagtgggctccagtctgaggatgaggctgactattattgtgcagcgtgggatgacggtctgagtgctgtggtcttcggcggagggaccaagctgaccgtcctgggtcagccaaggctgccccctcggtcactc

SEQ ID NO: 589469 - DNA, 494 bp, Homo sapiens; identical to SEQ ID NO: 534992
  misc_feature: HIJSMM301BPG47.9.1.A01.1.454.light.4.raw

SEQ ID NO: 589470 - DNA, 498 bp, Homo sapiens
  misc_feature: HIJSMM301ARLWG.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctacgtcagcccaaggccaaccccactcgt

SEQ ID NO: 589471 - DNA, 513 bp, Homo sapiens
  misc_feature: HIJSMM301B8U7F.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctcgccccctcggtcactctgttcccta

SEQ ID NO: 589472 - DNA, 487 bp, Homo sapiens
  misc_feature: HIJSMM301DHB9I.53.32.C10.1.454.light.4.raw
cgcgtatacacacgaccggtgctcgatttagtatagacatcaacacacaaaggggctgggcctcaggaagcagcatcggaggtgcctcagccatggcatggatccctctcttcctcggcgtccttgcttactgcacaggatcggtggcctcctatgagctgagtcagccaccctcagtgtccgtgtccccaggacagacagtccgcatcacctgctctggagataaattgggggataaatttgcttgctggtatcaacagaagacaggccagtcccctgtgttggtcatttatcaagatgacaagcggccctcagggatccctgagcggttctcgtggctccaactctgggaacacagccactctgaccatcagcgggacccaggctatggatgaggctgactattactgtcaggcgtgggacagcagcactatggtgttcggcggaggaccaagctcgaccgtcctaggtcagcccaaggctcccg

SEQ ID NO: 589473 - DNA, 497 bp, Homo sapiens; identical to SEQ ID NO: 535664
  misc_feature: HIJSMM301CODJ8.22.14.B03.1.454.light.4.raw

SEQ ID NO: 589474 - DNA, 494 bp, Homo sapiens; identical to SEQ ID NO: 534992
  misc_feature: HIJSMM301AWV3L.9.1.A01.1.454.light.4.raw

SEQ ID NO: 589475 - DNA, 501 bp, Homo sapiens
  misc_feature: HIJSMM301DB5RJ.52.35.D02.1.454.light.4.raw
cgcagtacgacacgaccggtgctcgatttagcacacgatagttgggtttggggggaactgctcagttaggacccagagggaaccatggaagccccagctcagcttctcttcctcctgctactctggctcccagataccaccggagaagttgtattgacacagtctccagccaccctgtctttgtctccgaggggggagagccaccctctcctgcagggccagtcagagtgttggcaacctcttagcctggtaccaacaaaacctggccaggctcccaggctcctcatctatgatgcatccacggagggccactggcatcccagccaggttcagtggcagtgggtctgagacagacttcactctcaccatcagtggcctcgagcctgaagattttgctagtttattactgtcagcagcgtagccactggctctctttcggcggagggaccaaggttgagatcaaacgaactgtggctgcaccatctgtcttcactcttcccg

SEQ ID NO: 589476 - DNA, 499 bp, Homo sapiens
  misc_feature: HIJSMM301C8V1F.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgcccccc

SEQ ID NO: 589477 - DNA, 479 bp, Homo sapiens
  misc_feature: HIJSMM301EO9HK.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttctaccatcagcagcctgcagcctgaagatattgcaacatattactgtcagcagtatgataatctcccgactcaccttcggccaaggacgacgactggaggattaaacgaactgtggctgcacca

SEQ ID NO: 589478 - DNA, 481 bp, Homo sapiens
  misc_feature: HIJSMM301AHXNQ.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtactacttttggccaggggaccgaagctggagatcaatcgaa

SEQ ID NO: 589479 - DNA, 475 bp, Homo sapiens
  misc_feature: HIJSMM301CHHQV.15.8.A08.1.454.light.4.raw
  modified_base (347)..(347): a, c, t, g, unknown or other
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagccccgnagtctgaagtattttgctagtttattactgtcagcaatataacaagtggccattcactttcggcccagggaccaaagtggatatcaaacgaactgtggctgcaccatctgtcttcatcttcccgccat

SEQ ID NO: 589480 - DNA, 519 bp, Homo sapiens
  misc_feature: HIJSMM301CZV3H.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaacctcatcatttatggtgtcactcgtcggccctcaggagtctctcatcgcttctcaggctccaagtctggcaacacggcctccctaaccatctctgggctccagtttgaggacgagtctactttattactgctagttcctttaaattaggcgccactctcgtggttttcggcggaggcaccgaagtgaccgtcctcggtcagcccaaggcctgccccctcggtcactctcg

SEQ ID NO: 589481 - DNA, 465 bp, Homo sapiens; identical to SEQ ID NO: 539935
  misc_feature: HIJSMM301C8XJV.3.20.B09.1.454.light.4.raw

SEQ ID NO: 589482 - DNA, 516 bp, Homo sapiens; identical to SEQ ID NO: 551269
  misc_feature: HIJSMM301AKO9M.47.53.E09.1.454.light.4.raw

SEQ ID NO: 589483 - DNA, 503 bp, Homo sapiens; identical to SEQ ID NO: 580712
  misc_feature: HIJSMM301BKJEX.47.55.E11.1.454.light.4.raw

SEQ ID NO: 589484 - DNA, 513 bp, Homo sapiens; identical to SEQ ID NO: 535849
  misc_feature: HIJSMM301DG621.10.80.H03.1.454.light.4.raw

SEQ ID NO: 589485 - DNA, 444 bp, Homo sapiens; identical to SEQ ID NO: 534993
  misc_feature: HIJSMM301BOJYH.5.9.A09.1.454.light.4.raw

SEQ ID NO: 589486 - DNA, 518 bp, Homo sapiens; identical to SEQ ID NO: 539372
  misc_feature: HIJSMM301AHYN1.7.86.H09.1.454.light.4.raw

SEQ ID NO: 589487 - DNA, 491 bp, Homo sapiens; identical to SEQ ID NO: 536211
  misc_feature: HIJSMM301B54VY.16.53.E09.1.454.light.4.raw

SEQ ID NO: 589488 - DNA, 460 bp, Homo sapiens; identical to SEQ ID NO: 537107
  misc_feature: HIJSMM301CQHW9.22.28.C06.1.454.light.4.raw

SEQ ID NO: 589489 - DNA, 502 bp, Homo sapiens; identical to SEQ ID NO: 541971
  misc_feature: HIJSMM301BEXUH.4.39.D06.1.454.light.4.raw

SEQ ID NO: 589490 - DNA, 515 bp, Homo sapiens; identical to SEQ ID NO: 544581
  misc_feature: HIJSMM301AJFNH.5.27.C05.1.454.light.4.raw

SEQ ID NO: 589491 - DNA, 493 bp, Homo sapiens
  misc_feature: HIJSMM301BQZL5.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaaacagacaccattggtacttatgtcttcggaactgcgaccaaggtcaccgtcctgggtcagccaaggccaaccccactgtca

SEQ ID NO: 589492 - DNA, 500 bp, Homo sapiens; identical to SEQ ID NO: 541228
  misc_feature: HIJSMM301CYQ2I.13.11.A11.1.454.light.4.raw

SEQ ID NO: 589493 - DNA, 502 bp, Homo sapiens; identical to SEQ ID NO: 537816
  misc_feature: HIJSMM301BEH2P.19.78.H01.1.454.light.4.raw

SEQ ID NO: 589494 - DNA, 505 bp, Homo sapiens
  misc_feature: HIJSMM301DT9FP.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgctagtttattactgtcagcagcgtgccactttcggcggaggtgccactttcggcggagggaccaaaatagaggtcaaacgaactgtggctgcaccatctgtcttctatt

SEQ ID NO: 589495 - DNA, 486 bp, Homo sapiens
  misc_feature: HIJSMM301DIZVI.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccagtggaccaagctggagatcacaggaactgtggctgcacc

SEQ ID NO: 589496 - DNA, 514 bp, Homo sapiens; identical to SEQ ID NO: 543870
  misc_feature: HIJSMM301DVXIL.40.12.B01.1.454.light.4.raw

SEQ ID NO: 589497 - DNA, 505 bp, Homo sapiens
  misc_feature: HIJSMM301DQA7Y.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggccaaggtggagatcaaacgaactgtggctgcaccatctgtt

SEQ ID NO: 589498 - DNA, 486 bp, Homo sapiens
  misc_feature: HIJSMM301ASO49.4.2.A02.1.454.light.4.raw
agcactgtagcacgaccggtgctcgatttagactcatctacaggggagtctcagtcaggacacagcatggacatgagggtccccgctcagctcctggggctcctgctactctggctccgagatgccagatgtcgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtcttcta

SEQ ID NO: 589499 - DNA, 505 bp, Homo sapiens
  misc_feature: HIJSMM301ANTNS.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcagtccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccaccct

SEQ ID NO: 589500 - DNA, 490 bp, Homo sapiens; identical to SEQ ID NO: 558521
  misc_feature: HIJSMM301A4PJE.16.72.G06.1.454.light.4.raw

SEQ ID NO: 589501 - DNA, 499 bp, Homo sapiens; identical to SEQ ID NO: 558887
  misc_feature: HIJSMM301DPDI2.14.35.D02.1.454.light.4.raw

SEQ ID NO: 589502 - DNA, 506 bp, Homo sapiens; identical to SEQ ID NO: 551763
  misc_feature: HIJSMM301A8EZQ.9.12.B01.1.454.light.4.raw

SEQ ID NO: 589503 - DNA, 488 bp, Homo sapiens
  misc_feature: HIJSMM301E3F7K.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggaggattaaacgaactagtggcgtgcaccact

SEQ ID NO: 589504 - DNA, 447 bp, Homo sapiens; identical to SEQ ID NO: 535020
  misc_feature: HIJSMM301D0PXA.18.9.A09.1.454.light.4.raw

SEQ ID NO: 589505 - DNA, 507 bp, Homo sapiens
  misc_feature: HIJSMM301AKQ0H.53.35.D02.1.454.light.4.raw
cgcgtatacacacgaccggtgctcgatttagcacacgatagttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcgggcgagggaccaaactgaccgtcctaggtcagcccaaggctgccccctcggtcactctgttccccg

SEQ ID NO: 589506 - DNA, 492 bp, Homo sapiens
  misc_feature: HIJSMM301BJ0I6.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgactcaccttcggccaaggacacgactggagattaaacgaactgtggctgcaccatctgtcttcatcc

SEQ ID NO: 589507 - DNA, 511 bp, Homo sapiens
  misc_feature: HIJSMM301CCGT9.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgctagtttattactgtcaacatcgtaccgagtggccgtccgggggccactttcggccctgggaccgaaggtggagatacaaacgaactgtggctgcaccatctgtcttcta

SEQ ID NO: 589508 - DNA, 483 bp, Homo sapiens
  misc_feature: HIJSMM301EA5FN.46.26.C04.1.454.light.4.raw
  modified_base (445)..(445): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntcactttcggcggagggaccaaggtggagatcaaacga

SEQ ID NO: 589509 - DNA, 462 bp, Homo sapiens
  misc_feature: HIJSMM301EJ2RR.49.73.G07.1.454.light.4.raw
agtcgagagacacgaccggtgctcgatttagctctacgctcaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctccgctcactttcggcggagggaccaaggtggagatcaaacgaa

SEQ ID NO: 589510 - DNA, 502 bp, Homo sapiens; identical to SEQ ID NO: 541971
  misc_feature: HIJSMM301DHVFD.4.39.D06.1.454.light.4.raw

SEQ ID NO: 589511 - DNA, 499 bp, Homo sapiens
  misc_feature: HIJSMM301B0EDY.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctggtcactctgttcccaccctcctctcgtcgagcgt

SEQ ID NO: 589512 - DNA, 487 bp, Homo sapiens; identical to SEQ ID NO: 536206
  misc_feature: HIJSMM301A3ZGF.47.38.D05.1.454.light.4.raw

SEQ ID NO: 589513 - DNA, 509 bp, Homo sapiens; identical to SEQ ID NO: 536047
  misc_feature: HIJSMM301APODH.17.33.C11.1.454.light.4.raw

SEQ ID NO: 589514 - DNA, 509 bp, Homo sapiens; identical to SEQ ID NO: 539359
  misc_feature: HIJSMM301CRDF6.47.85.H08.1.454.light.4.raw

SEQ ID NO: 589515 - DNA, 486 bp, Homo sapiens
  misc_feature: HIJSMM301C7673.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggtccaagggacacgactggagattaaacgaactgtggctgcacca

SEQ ID NO: 589516 - DNA, 506 bp, Homo sapiens
  misc_feature: HIJSMM301AVHLZ.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagattttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccaccctcctccgtgt

SEQ ID NO: 589517 - DNA, 501 bp, Homo sapiens
  misc_feature: HIJSMM301DWOVC.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggtcccgtcgggaccgaaacgtggagatacaaacgaaactgtggctgcaccatctgtctt

SEQ ID NO: 589518 - DNA, 488 bp, Homo sapiens; identical to SEQ ID NO: 537260
  misc_feature: HIJSMM301ASUJZ.47.70.G04.1.454.light.4.raw

SEQ ID NO: 589519 - DNA, 478 bp, Homo sapiens
  misc_feature: HIJSMM301DBBWV.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaacgcccccaaactcatgatttatgatgtcagtaagcggccctcgaggggtccctgatcgcttctctggctccaagtctggcaacacggcctcctgacatctctgggctccaggctgaggatgaggctgattattactgctgctcatatgcaggcagctacacttgggtgttcgggcggaggggaccaagctgaccgtcctaggtca

SEQ ID NO: 589520 - DNA, 514 bp, Homo sapiens
  misc_feature: HIJSMM301ANFC5.52.57.F02.1.454.light.4.raw
cgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcgcggagggaccaaggtgaccgtcctacgtcagcccaaggctgccccctggtcactctgtt

SEQ ID NO: 589521 - DNA, 480 bp, Homo sapiens
  misc_feature: HIJSMM301AZEA0.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtctacgtcagcccaaggctgccccctc

SEQ ID NO: 589522 - DNA, 470 bp, Homo sapiens; identical to SEQ ID NO: 536130
  misc_feature: HIJSMM301DL24L.7.81.H04.1.454.light.4.raw

SEQ ID NO: 589523 - DNA, 518 bp, Homo sapiens
  misc_feature: HIJSMM301B4V7I.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcggggggaccacactgaccgtcctaggtcagcccaaggctgccccctcggtcactctgttccccg

SEQ ID NO: 589524 - DNA, 488 bp, Homo sapiens
  misc_feature: HIJSMM301ANA3H.17.39.D06.1.454.light.4.raw
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccaccggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactgtggctgcacc

SEQ ID NO: 589525 - DNA, 494 bp, Homo sapiens; identical to SEQ ID NO: 534992
  misc_feature: HIJSMM301DEAEH.9.1.A01.1.454.light.4.raw

SEQ ID NO: 589526 - DNA, 509 bp, Homo sapiens
  misc_feature: HIJSMM301AWIYA.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgctagtttattactgtcaacatcgtaccgagtggccgtccggggccacttcggccctgggaccaaatgagatacaaacgaactgtggctgcaccatctgtcttcatccttcccg

SEQ ID NO: 589527 - DNA, 484 bp, Homo sapiens; identical to SEQ ID NO: 535400
  misc_feature: HIJSMM301DNFAU.46.26.C04.1.454.light.4.raw

SEQ ID NO: 589528 - DNA, 486 bp, Homo sapiens
  misc_feature: HIJSMM301D913A.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 589529 - DNA, 510 bp, Homo sapiens
  misc_feature: HIJSMM301CGFP4.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatccccagccaggttcagtggcagtgggtatgggacagacttcactctcaccatcatcagcctggagcctgaggatgttgcagtttattactgtcaacatcgtaccgagtggccgtccgggggccactttcggccctcgggaccaaagtggatatacaacgaactgtggctgcaccatctgtcttct

SEQ ID NO: 589530 - DNA, 485 bp, Homo sapiens; identical to SEQ ID NO: 535985
  misc_feature: HIJSMM301DSZTC.15.1.A01.1.454.light.4.raw

SEQ ID NO: 589531 - DNA, 486 bp, Homo sapiens; identical to SEQ ID NO: 535043
  misc_feature: HIJSMM301BTC21.46.35.D02.1.454.light.4.raw

SEQ ID NO: 589532 - DNA, 491 bp, Homo sapiens; identical to SEQ ID NO: 536211
  misc_feature: HIJSMM301CZW97.16.53.E09.1.454.light.4.raw

SEQ ID NO: 589533 - DNA, 510 bp, Homo sapiens
  misc_feature: HIJSMM301AL9Z9.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcgtcactctcg

SEQ ID NO: 589534 - DNA, 495 bp, Homo sapiens
  misc_feature: HIJSMM301DS15I.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtagtcacctgggacttttggccaggggaccaagctggagatcaaacgaactgtggctgcaccatctgtcttcta

SEQ ID NO: 589535 - DNA, 489 bp, Homo sapiens; identical to SEQ ID NO: 535638
  misc_feature: HIJSMM301A5GQT.3.55.E11.1.454.light.4.raw

SEQ ID NO: 589536 - DNA, 494 bp, Homo sapiens; identical to SEQ ID NO: 534994
  misc_feature: HIJSMM301DF3ZL.27.78.H01.1.454.light.4.raw

SEQ ID NO: 589537 - DNA, 499 bp, Homo sapiens; identical to SEQ ID NO: 551769
  misc_feature: HIJSMM301BSC8J.43.34.D01.1.454.light.4.raw

SEQ ID NO: 589538 - DNA, 485 bp, Homo sapiens; identical to SEQ ID NO: 568562
  misc_feature: HIJSMM301BKTVS.7.75.G09.1.454.light.4.raw

SEQ ID NO: 589539 - DNA, 508 bp, Homo sapiens
  misc_feature: HIJSMM301DWGV6.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcacttttcggcccggggaccaaagtggaaatcaaacgaactgtggctgcaccatctgtcttcatcttcccgcc

SEQ ID NO: 589540 - DNA, 508 bp, Homo sapiens
  misc_feature: HIJSMM301DL3GY.21.22.B11.1.454.light.4.raw
  modified_base (461)..(461): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttggggngttcgggcggagggaccaaactcggaaccgtcctaggtcagccccaa

SEQ ID NO: 589541 - DNA, 515 bp, Homo sapiens
  misc_feature: HIJSMM301BKUG9.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 589542 - DNA, 506 bp, Homo sapiens
  misc_feature: HIJSMM301BN34J.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcgggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctagtcagcccaaggccaacccactgtcact

SEQ ID NO: 589543 - DNA, 501 bp, Homo sapiens
  misc_feature: HIJSMM301BPIUO.16.53.E09.1.454.light.4.raw
  modified_base (485)..(485): a, c, t, g, unknown or other
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagaattttacactgaaaatcagcagagtggaggctgaggatgttgggggtttattaactgcatgcaagctctacaaactccttacactttggtccagggaccgaaagctggagatanaaacgaaactagtggc

SEQ ID NO: 589544 - DNA, 480 bp, Homo sapiens; identical to SEQ ID NO: 578118
  misc_feature: HIJSMM301BD8NW.40.23.C01.1.454.light.4.raw

SEQ ID NO: 589545 - DNA, 489 bp, Homo sapiens
  misc_feature: HIJSMM301EKA6O.48.54.E10.1.454.light.4.raw
agtatacatacacgaccggtgctcgatttagatcgtagcagaacacacaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggcccatcactgggctccagactgaggatgaggctgattattactgccagtcctatgacagcaacctggagcggttgggtgttcggcggagggacccta

SEQ ID NO: 589546 - DNA, 496 bp, Homo sapiens
  misc_feature: HIJSMM301C5LZI.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacgggaccgaacggtagggaaatacaaacgaacctagtggctgcaccta

SEQ ID NO: 589547 - DNA, 506 bp, Homo sapiens; identical to SEQ ID NO: 534969
  misc_feature: HIJSMM301BRL2D.18.37.D04.1.454.light.4.raw

SEQ ID NO: 589548 - DNA, 490 bp, Homo sapiens
  misc_feature: HIJSMM301CV439.19.5.A05.1.454.light.4.raw
  modified_base (484)..(484): a, c, t, g, unknown or other
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggacttcgcctcggacgtaaggtagaggatacagacgaactagtggcgtgcaccactactctnttccta

SEQ ID NO: 589549 - DNA, 458 bp, Homo sapiens
  misc_feature: HIJSMM301BS9C1.49.85.H08.1.454.light.4.raw
agtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcgggcggagggaccaagctgaccgt

SEQ ID NO: 589550 - DNA, 481 bp, Homo sapiens
  misc_feature: HIJSMM301EP51I.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagaccccg

SEQ ID NO: 589551 - DNA, 492 bp, Homo sapiens; identical to SEQ ID NO: 536010
  misc_feature: HIJSMM301DTWJ5.10.20.B09.1.454.light.4.raw

SEQ ID NO: 589552 - DNA, 495 bp, Homo sapiens; identical to SEQ ID NO: 535143
  misc_feature: HIJSMM301DCEC7.51.29.C07.1.454.light.4.raw

SEQ ID NO: 589553 - DNA, 514 bp, Homo sapiens
  misc_feature: HIJSMM301CU935.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatctcaactaaacatttttgctggtaccagcaattcccaggatcggccccccgactcctcatctatagaaatgatcatcggccctcggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaaagtcaagcccaaaggcctcgccccctc

SEQ ID NO: 589554 - DNA, 486 bp, Homo sapiens
  misc_feature: HIJSMM301C1P1C.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtggagtgtcagacgaactgtggctcgcaccat

SEQ ID NO: 589555 - DNA, 506 bp, Homo sapiens
  misc_feature: HIJSMM301A0ZWB.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggtccg

SEQ ID NO: 589556 - DNA, 506 bp, Homo sapiens
  misc_feature: HIJSMM301ETP3K.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgagccgactattactgtcacacgtgggacatgggcactgcgatcttcggcggagggaccaagctgaccgtcctgggtcagcccaaggctgccccctcggtcactctgttcccgccctcct

SEQ ID NO: 589557 - DNA, 493 bp, Homo sapiens; identical to SEQ ID NO: 535047
  misc_feature: HIJSMM301DFXZ2.16.53.E09.1.454.light.4.raw

SEQ ID NO: 589558 - DNA, 483 bp, Homo sapiens; identical to SEQ ID NO: 574472
  misc_feature: HIJSMM301A0PD6.26.60.F05.1.454.light.4.raw

SEQ ID NO: 589559 - DNA, 512 bp, Homo sapiens; identical to SEQ ID NO: 586385
  misc_feature: HIJSMM301BLI19.17.33.C11.1.454.light.4.raw
  modified_base (506)..(506): a, c, t, g, unknown or other

SEQ ID NO: 589560 - DNA, 491 bp, Homo sapiens
  misc_feature: HIJSMM301CFP40.49.61.F06.1.454.light.4.raw
agtcgagagacacgaccggtgctcgatttagctacgctctaagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 589561 - DNA, 504 bp, Homo sapiens
  misc_feature: HIJSMM301BJGZI.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaaggctgaccgtcctacggtcagcccaaggctgccccctcggtcactctgttccccg

SEQ ID NO: 589562 - DNA, 502 bp, Homo sapiens
  misc_feature: HIJSMM301BF9JC.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctgccccctcggtcacttc

SEQ ID NO: 589563 - DNA, 485 bp, Homo sapiens; identical to SEQ ID NO: 536040
  misc_feature: HIJSMM301EIANV.15.1.A01.1.454.light.4.raw

SEQ ID NO: 589564 - DNA, 520 bp, Homo sapiens; identical to SEQ ID NO: 537173
  misc_feature: HIJSMM301B15BU.27.23.C01.1.454.light.4.raw

SEQ ID NO: 589565 - DNA, 497 bp, Homo sapiens; identical to SEQ ID NO: 561967
  misc_feature: HIJSMM301BDLUL.12.38.D05.1.454.light.4.raw

SEQ ID NO: 589566 - DNA, 510 bp, Homo sapiens; identical to SEQ ID NO: 553863
  misc_feature: HIJSMM301CDWJQ.16.46.E02.1.454.light.4.raw

SEQ ID NO: 589567 - DNA, 468 bp, Homo sapiens
  misc_feature: HIJSMM301D2VC0.3.68.G02.1.454.light.4.raw
agacgcactccacgaccggtgctcgatttagtcgatagtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtacccctccgacttttggccagggaccaagctggagatcaaacgaa

SEQ ID NO: 589568 - DNA, 508 bp, Homo sapiens
  misc_feature: HIJSMM301BX5XJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaaggaccgaaggtaggaaagtacaaacgaactagtggtcgtgcaccatctgtcttcatcttccccg

SEQ ID NO: 589569 - DNA, 501 bp, Homo sapiens
  misc_feature: HIJSMM301EN6H0.48.58.F03.1.454.light.4.raw
  modified_base (471)..(471): a, c, t, g, unknown or other
agtatacatacacgaccggtgctcgatttagtctgatcgagaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagttacgtcggaccttcggccaagggacacgactggagattaaacgaactntggctgcaccatctgtcttcatcttccccg

SEQ ID NO: 589570 - DNA, 492 bp, Homo sapiens
  misc_feature: HIJSMM301C0JIW.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcaggtgggtttgggacagagttcactctcaccatcagcagcctgcagtctgaagtatttgctagtttattactgtcagcagtataataactggcctccggtcactttcggcggagggaccaaggtggagatacaaacgaactgtggctgcaccat

SEQ ID NO: 589571 - DNA, 478 bp, Homo sapiens; identical to SEQ ID NO: 563839
  misc_feature: HIJSMM301AGZLI.13.11.A11.1.454.light.4.raw

SEQ ID NO: 589572 - DNA, 494 bp, Homo sapiens; identical to SEQ ID NO: 534992
  misc_feature: HIJSMM301AQSK9.9.1.A01.1.454.light.4.raw

SEQ ID NO: 589573 - DNA, 490 bp, Homo sapiens
  misc_feature: HIJSMM301C5XGT.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattatactgccactcctatgacaacagcctgagtatttggctgttcggcggcgggaccaagttgaccgtcctacg

SEQ ID NO: 589574 - DNA, 441 bp, Homo sapiens; identical to SEQ ID NO: 535074
  misc_feature: HIJSMM301D8JTO.11.3.A03.1.454.light.4.raw

SEQ ID NO: 589575 - DNA, 477 bp, Homo sapiens; identical to SEQ ID NO: 542993
  misc_feature: HIJSMM301BTEV2.49.27.C05.1.454.light.4.raw

SEQ ID NO: 589576 - DNA, 477 bp, Homo sapiens
  misc_feature: HIJSMM301AD1OI.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccactc

SEQ ID NO: 589577 - DNA, 492 bp, Homo sapiens
  misc_feature: HIJSMM301DSQN0.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggcctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtctgggtcagcccaaggctcgcccctcggtcact

SEQ ID NO: 589578 - DNA, 510 bp, Homo sapiens
  misc_feature: HIJSMM301AH2VB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaacgggaccgaacggtaggaaagtacaaacgaactagtggctgcaccatctgtcttcatcttccccg

SEQ ID NO: 589579 - DNA, 494 bp, Homo sapiens; identical to SEQ ID NO: 536974
  misc_feature: HIJSMM301C7CXU.16.86.H09.1.454.light.4.raw

SEQ ID NO: 589580 - DNA, 514 bp, Homo sapiens
  misc_feature: HIJSMM301DBHGH.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctcgttcccgccctcctcga

SEQ ID NO: 589581 - DNA, 486 bp, Homo sapiens; identical to SEQ ID NO: 537840
  misc_feature: HIJSMM301CU1VY.40.81.H04.1.454.light.4.raw

SEQ ID NO: 589582 - DNA, 485 bp, Homo sapiens; identical to SEQ ID NO: 536723
  misc_feature: HIJSMM301EQNFQ.5.40.D07.1.454.light.4.raw

SEQ ID NO: 589583 - DNA, 493 bp, Homo sapiens
  misc_feature: HIJSMM301EW9BQ.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatacaaacgaactgtgg

SEQ ID NO: 589584 - DNA, 505 bp, Homo sapiens; identical to SEQ ID NO: 535987
  misc_feature: HIJSMM301BC394.18.37.D04.1.454.light.4.raw

SEQ ID NO: 589585 - DNA, 514 bp, Homo sapiens; identical to SEQ ID NO: 550589
  misc_feature: HIJSMM301CLIUQ.16.66.F11.1.454.light.4.raw

SEQ ID NO: 589586 - DNA, 518 bp, Homo sapiens
  misc_feature: HIJSMM301CAVBY.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaaccccac

SEQ ID NO: 589587 - DNA, 481 bp, Homo sapiens; identical to SEQ ID NO: 535993
  misc_feature: HIJSMM301CUFBJ.21.25.C03.1.454.light.4.raw

SEQ ID NO: 589588 - DNA, 494 bp, Homo sapiens
  misc_feature: HIJSMM301BV7MO.26.46.E02.1.454.light.4.raw
agactatactcacgaccggtgctcgatttagactcatctacagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 589589 - DNA, 491 bp, Homo sapiens; identical to SEQ ID NO: 535294
  misc_feature: HIJSMM301CLYCZ.16.68.G02.1.454.light.4.raw

SEQ ID NO: 589590 - DNA, 500 bp, Homo sapiens
  misc_feature: HIJSMM301EJCL7.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcgagggaccaaggtggagatcaaacgaactgtggctgcaccatctgtctt

SEQ ID NO: 589591 - DNA, 506 bp, Homo sapiens
  misc_feature: HIJSMM301CEEC7.40.45.E01.1.454.light.4.raw
tctagcgactcacgaccggtgctcgatttagtgagtcagtaagggaaagggggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggccgtcccggccaggttcagtggcagtgggtctgggacagacttcactctcaccatcagcagcctagagcctgaagattttgctagtttattactgtcagcagcgtgccaactggcctctcactttcggcggagggaccaaggtggagatacaaacgaactgtggctgcaccatctgtcttcatcttcccgccta

SEQ ID NO: 589592 - DNA, 434 bp, Homo sapiens; identical to SEQ ID NO: 578467
  misc_feature: HIJSMM301ELYKP.18.5.A05.1.454.light.4.raw

SEQ ID NO: 589593 - DNA, 517 bp, Homo sapiens
  misc_feature: HIJSMM301CZSU3.51.43.D10.1.454.light.4.raw
cgatcgtatacacgaccggtgctcgatttagactagcagtaaggggagtctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccaccctcctctcg

SEQ ID NO: 589594 - DNA, 522 bp, Homo sapiens; identical to SEQ ID NO: 543352
  misc_feature: HIJSMM301CBDKU.27.23.C01.1.454.light.4.raw

SEQ ID NO: 589595 - DNA, 493 bp, Homo sapiens; identical to SEQ ID NO: 536769
  misc_feature: HIJSMM301BVBDE.19.83.H06.1.454.light.4.raw

SEQ ID NO: 589596 - DNA, 483 bp, Homo sapiens
  misc_feature: HIJSMM301CJD8Z.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatagtcagacgaa

SEQ ID NO: 589597 - DNA, 499 bp, Homo sapiens; identical to SEQ ID NO: 557364
  misc_feature: HIJSMM301EY8CS.40.57.F02.1.454.light.4.raw

SEQ ID NO: 589598 - DNA, 494 bp, Homo sapiens
  misc_feature: HIJSMM301B557D.10.11.A11.1.454.light.4.raw
catagtagtgcacgaccggtgctcgatttagctacgactgcgaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggcccaggcccccagactcatcatttctgatgtcagtgatcggccctttggtatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 589599 - DNA, 483 bp, Homo sapiens; identical to SEQ ID NO: 542200
  misc_feature: HIJSMM301EGJTG.7.75.G09.1.454.light.4.raw

SEQ ID NO: 589600 - DNA, 501 bp, Homo sapiens
  misc_feature: HIJSMM301AKD1P.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgtcgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 589601 - DNA, 503 bp, Homo sapiens
  misc_feature: HIJSMM301EJ2FO.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctcgccccctcggtcactctcgttcccaccct

SEQ ID NO: 589602 - DNA, 514 bp, Homo sapiens
  misc_feature: HIJSMM301BD7RI.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgcctcctcg

SEQ ID NO: 589603 - DNA, 508 bp, Homo sapiens
  misc_feature: HIJSMM301BSRUG.47.83.H06.1.454.light.4.raw
agctcacgtacacgaccggtgctcgatttagatcacgtgcgtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcactctgtt

SEQ ID NO: 589604 - DNA, 488 bp, Homo sapiens; identical to SEQ ID NO: 535081
  misc_feature: HIJSMM301BM7VN.26.23.C01.1.454.light.4.raw

SEQ ID NO: 589605 - DNA, 486 bp, Homo sapiens; identical to SEQ ID NO: 535385
  misc_feature: HIJSMM301C3GAK.19.71.G05.1.454.light.4.raw

SEQ ID NO: 589606 - DNA, 492 bp, Homo sapiens
  misc_feature: HIJSMM301BAC4D.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcact

SEQ ID NO: 589607 - DNA, 496 bp, Homo sapiens
  misc_feature: HIJSMM301C253R.51.83.H06.1.454.light.4.raw
cgatcgtatacacgaccggtgctcgatttagatcacgtgcgtcgcggggcagagccctggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccagggaccgaaggtggaatacaaacgaactagtggctgcacc

SEQ ID NO: 589608 - DNA, 511 bp, Homo sapiens
  misc_feature: HIJSMM301CUPV3.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttctcaccctcctcgctacgt

SEQ ID NO: 589609 - DNA, 498 bp, Homo sapiens; identical to SEQ ID NO: 583633
  misc_feature: HIJSMM301CSLDZ.3.71.G05.1.454.light.4.raw

SEQ ID NO: 589610 - DNA, 509 bp, Homo sapiens; identical to SEQ ID NO: 539138
  misc_feature: HIJSMM301AZ47Z.17.33.C11.1.454.light.4.raw

SEQ ID NO: 589611 - DNA, 473 bp, Homo sapiens; identical to SEQ ID NO: 535262
  misc_feature: HIJSMM301CG94D.8.67.G01.1.454.light.4.raw

SEQ ID NO: 589612 - DNA, 484 bp, Homo sapiens
  misc_feature: HIJSMM301CPLDW.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggct

SEQ ID NO: 589613 - DNA, 484 bp, Homo sapiens
  misc_feature: HIJSMM301DOX5K.41.17.B06.1.454.light.4.raw
tctatactatcacgaccggtgctcgatttagtcgatagtgaaggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggcctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctctactttcggcggagggaccaaggtggagatcagacgaactgtggctgcaccatt

SEQ ID NO: 589614 - DNA, 444 bp, Homo sapiens; identical to SEQ ID NO: 534993
  misc_feature: HIJSMM301CNR58.5.9.A09.1.454.light.4.raw

SEQ ID NO: 589615 - DNA, 496 bp, Homo sapiens
  misc_feature: HIJSMM301BN4LD.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtctacc

SEQ ID NO: 589616 - DNA, 484 bp, Homo sapiens; identical to SEQ ID NO: 535400
  misc_feature: HIJSMM301D2DAO.46.26.C04.1.454.light.4.raw

SEQ ID NO: 589617 - DNA, 494 bp, Homo sapiens; identical to SEQ ID NO: 535680
  misc_feature: HIJSMM301CCP0U.16.78.H01.1.454.light.4.raw

SEQ ID NO: 589618 - DNA, 474 bp, Homo sapiens
  misc_feature: HIJSMM301ADBK1.48.38.D05.1.454.light.4.raw
agtatacatacacgaccggtgctcgatttagtatctgatagttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctagtcag

SEQ ID NO: 589619 - DNA, 507 bp, Homo sapiens; identical to SEQ ID NO: 539817
  misc_feature: HIJSMM301A21K3.5.24.C02.1.454.light.4.raw

SEQ ID NO: 589620 - DNA, 505 bp, Homo sapiens
  misc_feature: HIJSMM301AG97U.22.46.E02.1.454.light.4.raw
acatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagccaaggctgccccctggtcact

SEQ ID NO: 589621 - DNA, 486 bp, Homo sapiens
  misc_feature: HIJSMM301E1KTF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgtcagtctattactgtcagcagtatggtcacgtcccaagaacttttggccaggggaccaagctggagatcaaacgaactgtggctgcaccat

SEQ ID NO: 589622 - DNA, 521 bp, Homo sapiens; identical to SEQ ID NO: 538715
  misc_feature: HIJSMM301AR256.27.23.C01.1.454.light.4.raw

SEQ ID NO: 589623 - DNA, 496 bp, Homo sapiens
  misc_feature: HIJSMM301D6LI4.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgttctt

SEQ ID NO: 589624 - DNA, 511 bp, Homo sapiens
  misc_feature: HIJSMM301C2T0G.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccc

SEQ ID NO: 589625 - DNA, 495 bp, Homo sapiens
  misc_feature: HIJSMM301AQ4A3.40.22.B11.1.454.light.4.raw
tctagcgactcacgaccggtgctcgatttagacgacagctcaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccaagggaccaaaggtggaaatcaaacgaaacctgtggctgcacca

SEQ ID NO: 589626 - DNA, 496 bp, Homo sapiens
  misc_feature: HIJSMM301EKOVM.3.71.G05.1.454.light.4.raw
  modified_base (344)..(344): a, c, t, g, unknown or other
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacncagcttccttgaccatcactggggctcaggcggaagatgaggctgactattactgtaactcccgggccagcagtggtaacattgtgatattcggcggagggaccaaggtgaccgtcctacgtcagcccaaggctgccccctggtcactctcg

SEQ ID NO: 589627 - DNA, 497 bp, Homo sapiens; identical to SEQ ID NO: 536371
  misc_feature: HIJSMM301CRX34.16.78.H01.1.454.light.4.raw

SEQ ID NO: 589628 - DNA, 499 bp, Homo sapiens; identical to SEQ ID NO: 545133
  misc_feature: HIJSMM301EZ7BD.48.83.H06.1.454.light.4.raw

SEQ ID NO: 589629 - DNA, 516 bp, Homo sapiens; identical to SEQ ID NO: 546969
  misc_feature: HIJSMM301D1195.22.30.C08.1.454.light.4.raw

SEQ ID NO: 589630 - DNA, 488 bp, Homo sapiens; identical to SEQ ID NO: 542120
  misc_feature: HIJSMM301DHYKY.47.38.D05.1.454.light.4.raw

SEQ ID NO: 589631 - DNA, 502 bp, Homo sapiens
  misc_feature: HIJSMM301EDHEU.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactgtggctgcacatctgtcttcatcttcccgccta

SEQ ID NO: 589632 - DNA, 506 bp, Homo sapiens; identical to SEQ ID NO: 551204
  misc_feature: HIJSMM301CZE0D.15.59.F04.1.454.light.4.raw

SEQ ID NO: 589633 - DNA, 494 bp, Homo sapiens; identical to SEQ ID NO: 534994
  misc_feature: HIJSMM301ENSLT.27.78.H01.1.454.light.4.raw

SEQ ID NO: 589634 - DNA, 493 bp, Homo sapiens; identical to SEQ ID NO: 535047
  misc_feature: HIJSMM301DTDG5.16.53.E09.1.454.light.4.raw

SEQ ID NO: 589635 - DNA, 499 bp, Homo sapiens
  misc_feature: HIJSMM301B7PQR.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcaggcgggtctgggacagatttcactctcaccatcagcagcctgcaggttgaagatgtggctagtttattactgtcagcagtattatactactcctctgtacgttcggaccaagggaccaaaggtggagatacaaacgaactgtggctgcacat

SEQ ID NO: 589636 - DNA, 493 bp, Homo sapiens; identical to SEQ ID NO: 542591
  misc_feature: HIJSMM301BPVLB.9.1.A01.1.454.light.4.raw

SEQ ID NO: 589637 - DNA, 462 bp, Homo sapiens; identical to SEQ ID NO: 553042
  misc_feature: HIJSMM301B9Z35.49.8.A08.1.454.light.4.raw

SEQ ID NO: 589638 - DNA, 496 bp, Homo sapiens; identical to SEQ ID NO: 538149
  misc_feature: HIJSMM301C2VIB.13.67.G01.1.454.light.4.raw

SEQ ID NO: 589639 - DNA, 454 bp, Homo sapiens; identical to SEQ ID NO: 535005
  misc_feature: HIJSMM301EOJK2.19.86.H09.1.454.light.4.raw

SEQ ID NO: 589640 - DNA, 505 bp, Homo sapiens
  misc_feature: HIJSMM301ERD17.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggtca

SEQ ID NO: 589641 - DNA, 520 bp, Homo sapiens; identical to SEQ ID NO: 537173
  misc_feature: HIJSMM301BL6JK.27.23.C01.1.454.light.4.raw

SEQ ID NO: 589642 - DNA, 479 bp, Homo sapiens; identical to SEQ ID NO: 560190
  misc_feature: HIJSMM301AP288.5.12.B01.1.454.light.4.raw

SEQ ID NO: 589643 - DNA, 496 bp, Homo sapiens
  misc_feature: HIJSMM301A4QVG.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctcgccccctccggtcact

SEQ ID NO: 589644 - DNA, 488 bp, Homo sapiens; identical to SEQ ID NO: 539612
  misc_feature: HIJSMM301C4HWL.3.55.E11.1.454.light.4.raw

SEQ ID NO: 589645 - DNA, 491 bp, Homo sapiens
  misc_feature: HIJSMM301C4RKR.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctggtcact

SEQ ID NO: 589646 - DNA, 501 bp, Homo sapiens
  misc_feature: HIJSMM301DRW9S.41.18.B07.1.454.light.4.raw
  modified_base (476)..(476): a, c, t, g, unknown or other
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagatagcagtggtccttatcgggtgttcggcgggggaccaagctgaccgtcctaggtcagcccaaggcngccccctcggtcactctgttccccg

SEQ ID NO: 589647 - DNA, 486 bp, Homo sapiens; identical to SEQ ID NO: 535043
  misc_feature: HIJSMM301AFHEW.46.35.D02.1.454.light.4.raw

SEQ ID NO: 589648 - DNA, 486 bp, Homo sapiens
  misc_feature: HIJSMM301CZS3V.51.41.D08.1.454.light.4.raw
cgatcgtatacacgaccggtgctcgatttagtcacgcgagaaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggaggatcaaacgaactgtggctgcaccta

SEQ ID NO: 589649 - DNA, 504 bp, Homo sapiens
  misc_feature: HIJSMM301B31OM.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgaggccgactattactgtcaggtgtgggatagtagtggtgatcatccatacgtcttcggaactgggaccaaggtctccgtcctacgtcagcccaaggccaactccactgtcactctgtt

SEQ ID NO: 589650 - DNA, 501 bp, Homo sapiens; identical to SEQ ID NO: 535746
  misc_feature: HIJSMM301C972D.18.11.A11.1.454.light.4.raw

SEQ ID NO: 589651 - DNA, 494 bp, Homo sapiens
  misc_feature: HIJSMM301A4X9I.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtactacttttggccaggggaccaacctggagatcagacgaa

SEQ ID NO: 589652 - DNA, 486 bp, Homo sapiens; identical to SEQ ID NO: 535043
  misc_feature: HIJSMM301AIUKK.46.35.D02.1.454.light.4.raw

SEQ ID NO: 589653 - DNA, 508 bp, Homo sapiens; identical to SEQ ID NO: 550380
  misc_feature: HIJSMM301BAF8K.4.57.F02.1.454.light.4.raw

SEQ ID NO: 589654 - DNA, 486 bp, Homo sapiens; identical to SEQ ID NO: 535043
  misc_feature: HIJSMM301ESJOE.46.35.D02.1.454.light.4.raw

SEQ ID NO: 589655 - DNA, 491 bp, Homo sapiens; identical to SEQ ID NO: 536211
  misc_feature: HIJSMM301BKFZO.16.53.E09.1.454.light.4.raw

SEQ ID NO: 589656 - DNA, 490 bp, Homo sapiens; identical to SEQ ID NO: 541141
  misc_feature: HIJSMM301AIYJZ.47.38.D05.1.454.light.4.raw

SEQ ID NO: 589657 - DNA, 502 bp, Homo sapiens; identical to SEQ ID NO: 537298
  misc_feature: HIJSMM301DF7AJ.27.78.H01.1.454.light.4.raw

SEQ ID NO: 589658 - DNA, 383 bp, Homo sapiens; identical to SEQ ID NO: 550682
  misc_feature: HIJSMM301AGALW.48.87.H10.1.454.light.4.raw

SEQ ID NO: 589659 - DNA, 511 bp, Homo sapiens
  misc_feature: HIJSMM301ESN9U.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctcgtcctggtcatttatgaggacaagaaacgaccctccgggatccctgacagactctctggctccagctcagggacagtggccacctttgactatcactggggcccgaggtggaggatgaaggagactactattgttactctccagagaaggatggtcatcattgggtggttcggcggagggaccgaagctgaccgtcctaagtcagcccaaggctgccccctcggtcactctgttcccacccct

SEQ ID NO: 589660 - DNA, 510 bp, Homo sapiens
  misc_feature: HIJSMM301ELWCN.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaaagcgaactgtggctgcaccatctgtcttcatcttcccg

SEQ ID NO: 589661 - DNA, 463 bp, Homo sapiens; identical to SEQ ID NO: 535062
  misc_feature: HIJSMM301E0LVC.11.73.G07.1.454.light.4.raw

SEQ ID NO: 589662 - DNA, 487 bp, Homo sapiens
  misc_feature: HIJSMM301B491H.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtggatatcagacgaa

SEQ ID NO: 589663 - DNA, 503 bp, Homo sapiens
  misc_feature: HIJSMM301CEGZ0.49.35.D02.1.454.light.4.raw
agtcgagagacacgaccggtgctcgatttagcacacgatagttgggtttgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggtagggaccaggctgaccgtcctgggtcagcccaaggctgcccctcggtcactctgttccccg

SEQ ID NO: 589664 - DNA, 510 bp, Homo sapiens
  misc_feature: HIJSMM301BCH3J.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactcgtcactctgttcccgt

SEQ ID NO: 589665 - DNA, 505 bp, Homo sapiens
  misc_feature: HIJSMM301DV2NR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaaggtggaaatacaaacgaactgtggctgcaccatctgtcttcatcttccccg

SEQ ID NO: 589666 - DNA, 485 bp, Homo sapiens; identical to SEQ ID NO: 535880
  misc_feature: HIJSMM301BHB7V.7.75.G09.1.454.light.4.raw

SEQ ID NO: 589667 - DNA, 494 bp, Homo sapiens; identical to SEQ ID NO: 535497
  misc_feature: HIJSMM301CUDZ5.43.72.G06.1.454.light.4.raw

SEQ ID NO: 589668 - DNA, 504 bp, Homo sapiens
  misc_feature: HIJSMM301A518E.48.8.A08.1.454.light.4.raw
agtatacatacacgaccggtgctcgatttagcatactctacaggggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgtcagcaccgtaaaacctggcctctgagtggttttggccaggggaccaagctggacatcaaacgaactgtggctgcaccatctgtcttcatcttcccgccta

SEQ ID NO: 589669 - DNA, 487 bp, Homo sapiens; identical to SEQ ID NO: 543396
  misc_feature: HIJSMM301EP93U.46.26.C04.1.454.light.4.raw

SEQ ID NO: 589670 - DNA, 471 bp, Homo sapiens
  misc_feature: HIJSMM301B82RV.48.51.E07.1.454.light.4.raw
agtatacatacacgaccggtgctcgatttagcatactctacaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgacccgtacaattttggccaggggaccaagctggagatcaaacgaa

SEQ ID NO: 589671 - DNA, 503 bp, Homo sapiens
  misc_feature: HIJSMM301AINSO.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccagggggacccaggtggagatcagacgacagtgtactgcaacgatcttgtacgtacgtatctaccgta

SEQ ID NO: 589672 - DNA, 496 bp, Homo sapiens
  misc_feature: HIJSMM301DZ75W.48.33.C11.1.454.light.4.raw
agtatacatacacgaccggtgctcgatttagagtgagctcgttgggtttggggacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggccaaaggtggaaatcagacgaactgtggctgcaccat

SEQ ID NO: 589673 - DNA, 494 bp, Homo sapiens; identical to SEQ ID NO: 534994
  misc_feature: HIJSMM301AG0V2.27.78.H01.1.454.light.4.raw

SEQ ID NO: 589674 - DNA, 499 bp, Homo sapiens; identical to SEQ ID NO: 572008
  misc_feature: HIJSMM301AU7C8.14.35.D02.1.454.light.4.raw

SEQ ID NO: 589675 - DNA, 484 bp, Homo sapiens; identical to SEQ ID NO: 535400
  misc_feature: HIJSMM301EURYS.46.26.C04.1.454.light.4.raw

SEQ ID NO: 589676 - DNA, 489 bp, Homo sapiens
  misc_feature: HIJSMM301B1GX9.52.82.H05.1.454.light.4.raw
cgcagtacgacacgaccggtgctcgatttagtcgagctctctcgcggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttctatgtcttcgcaactggaccaaggtcaccgtctaggtcagaccccg

SEQ ID NO: 589677 - DNA, 507 bp, Homo sapiens
  misc_feature: HIJSMM301A2MZ7.3.33.C11.1.454.light.4.raw
agacgcactccacgaccggtgctcgatttagagtgagctcgttggggtttggggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcaacccaaggcaaagcccccaaactcaatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaactactgttttcggcggagggaccaagctgaccgtctaggtcacgcccaaggctgccccctcggtccactcctgttccccaccctcctcgagtcggcgtct

SEQ ID NO: 589678 - DNA, 508 bp, Homo sapiens
  misc_feature: HIJSMM301CSZQ4.8.71.G05.1.454.light.4.raw
ctcgcgtgtccacgaccggtgctcgatttagtgtcgtcgcaagagagagggggtgaggtgaagatgagctggaggaccgcaataggggtaggtcccctgtggaaaagggtcagaggccaaaggatgggaggggtcaggctggaactgaggagcaggtggggcacttctccctctaacactctcccctgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatctgagacacgcgag

SEQ ID NO: 589679 - DNA, 483 bp, Homo sapiens
  misc_feature: HIJSMM301A6HB5.43.50.E06.1.454.light.4.raw
tgtgagtagtcacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaaggaccaaggtggaaataaaacgaactagtggctgcacc

SEQ ID NO: 589680 - DNA, 512 bp, Homo sapiens
  misc_feature: HIJSMM301A6UHN.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggcccgtcgggaccgaaagtggatatcaaacgaactgtggctgcaccactctgtcttcta

SEQ ID NO: 589681 - DNA, 501 bp, Homo sapiens
  misc_feature: HIJSMM301EO2W9.48.35.D02.1.454.light.4.raw
agtatacatacacgaccggtgctcgatttagcacacgatagttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttcccg

SEQ ID NO: 589682 - DNA, 489 bp, Homo sapiens
  misc_feature: HIJSMM301AO6LH.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgctacttttggccaggggaccaaagttgagatcaaacgaactgtggctgcaccatctgt

SEQ ID NO: 589683 - DNA, 444 bp, Homo sapiens; identical to SEQ ID NO: 535192
  misc_feature: HIJSMM301D4YTR.5.9.A09.1.454.light.4.raw

SEQ ID NO: 589684 - DNA, 522 bp, Homo sapiens
  misc_feature: HIJSMM301CJDZI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggagggaccaggctgaccgtcctaggtcagcccaaggctgccccctcggtcactctgttcccgccct

SEQ ID NO: 589685 - DNA, 478 bp, Homo sapiens
  misc_feature: HIJSMM301EQIX1.13.76.G10.1.454.light.4.raw
tcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactgggctccaggctgaggatgaggctgattattcttgccagtcctatgacagcagcctgagtgcttcggtattcggcggggggacccac

SEQ ID NO: 589686 - DNA, 485 bp, Homo sapiens; identical to SEQ ID NO: 535606
  misc_feature: HIJSMM301CE5FY.47.46.E02.1.454.light.4.raw

SEQ ID NO: 589687 - DNA, 498 bp, Homo sapiens
  misc_feature: HIJSMM301E0K1W.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttaat

SEQ ID NO: 589688 - DNA, 495 bp, Homo sapiens; identical to SEQ ID NO: 535821
  misc_feature: HIJSMM301BEVRL.3.31.C09.1.454.light.4.raw

SEQ ID NO: 589689 - DNA, 501 bp, Homo sapiens
  misc_feature: HIJSMM301B5Z72.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtgagatcaaacgaactgtggctgcaccatctgtctcatcttcccgcat

SEQ ID NO: 589690 - DNA, 502 bp, Homo sapiens
  misc_feature: HIJSMM301C0A9J.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatggacaatctgagcggttgggtgttcggcggagggaccaaactgaccgtctaggtcagcccaa

SEQ ID NO: 589691 - DNA, 490 bp, Homo sapiens
  misc_feature: HIJSMM301AVTFO.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcgcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 589692 - DNA, 502 bp, Homo sapiens
  misc_feature: HIJSMM301EDUKI.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcatctctatgtcttcggaactgggaccaaggtcaccgtcctaggtcagcccaaggccaacccca

SEQ ID NO: 589693 - DNA, 501 bp, Homo sapiens; identical to SEQ ID NO: 543209
  misc_feature: HIJSMM301CPUMJ.52.55.E11.1.454.light.4.raw

SEQ ID NO: 589694 - DNA, 513 bp, Homo sapiens
  misc_feature: HIJSMM301ELMFS.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccaccctcctc

SEQ ID NO: 589695 - DNA, 444 bp, Homo sapiens; identical to SEQ ID NO: 534993
  misc_feature: HIJSMM301AZ1NH.5.9.A09.1.454.light.4.raw

SEQ ID NO: 589696 - DNA, 494 bp, Homo sapiens
  misc_feature: HIJSMM301BB0LN.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaacggaccgaacggtaggaaagtactaaacgaaactagtggcgtcgcacca

SEQ ID NO: 589697 - DNA, 486 bp, Homo sapiens
  misc_feature: HIJSMM301D19LY.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggcctaggggaccaggctggagatcagacgaactgtggtc

SEQ ID NO: 589698 - DNA, 519 bp, Homo sapiens; identical to SEQ ID NO: 543692
  misc_feature: HIJSMM301DDDN5.41.19.B08.1.454.light.4.raw

SEQ ID NO: 589699 - DNA, 472 bp, Homo sapiens; identical to SEQ ID NO: 535898
  misc_feature: HIJSMM301DOKP1.15.8.A08.1.454.light.4.raw

SEQ ID NO: 589700 - DNA, 496 bp, Homo sapiens
  misc_feature: HIJSMM301C5B0M.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctgcccccg

SEQ ID NO: 589701 - DNA, 495 bp, Homo sapiens; identical to SEQ ID NO: 538920
  misc_feature: HIJSMM301EKKL8.47.64.F09.1.454.light.4.raw

SEQ ID NO: 589702 - DNA, 499 bp, Homo sapiens; identical to SEQ ID NO: 547044
  misc_feature: HIJSMM301AYFYV.43.71.G05.1.454.light.4.raw

SEQ ID NO: 589703 - DNA, 490 bp, Homo sapiens
  misc_feature: HIJSMM301A0BLW.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcaggtggaggctgaggatgtcggggtttactactgcatgcagggtacactctggccgttcacttttggccagggggaccaaactggatatcagacgaactgtggctgca

SEQ ID NO: 589704 - DNA, 490 bp, Homo sapiens; identical to SEQ ID NO: 535420
  misc_feature: HIJSMM301ELXJU.3.72.G06.1.454.light.4.raw

SEQ ID NO: 589705 - DNA, 508 bp, Homo sapiens
  misc_feature: HIJSMM301CA0LE.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttccccaccctcctcgctacgtaga

SEQ ID NO: 589706 - DNA, 487 bp, Homo sapiens; identical to SEQ ID NO: 557252
  misc_feature: HIJSMM301DQL5S.46.35.D02.1.454.light.4.raw

SEQ ID NO: 589707 - DNA, 495 bp, Homo sapiens; identical to SEQ ID NO: 535486
  misc_feature: HIJSMM301ATCNI.26.72.G06.1.454.light.4.raw

SEQ ID NO: 589708 - DNA, 506 bp, Homo sapiens
  misc_feature: HIJSMM301AHXVW.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaaggtggacctcaaacgaactgtggctgcaccatctgtcttcatccttcccgcc

SEQ ID NO: 589709 - DNA, 496 bp, Homo sapiens
  misc_feature: HIJSMM301AC855.47.64.F09.1.454.light.4.raw
agctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggtcggagggaccgagggtggaggatcaaacgaactgtggctgcaccatctgtcttcat

SEQ ID NO: 589710 - DNA, 494 bp, Homo sapiens; identical to SEQ ID NO: 541035
  misc_feature: HIJSMM301EETV2.26.12.B01.1.454.light.4.raw

SEQ ID NO: 589711 - DNA, 504 bp, Homo sapiens; identical to SEQ ID NO: 547181
  misc_feature: HIJSMM301B8I4J.14.57.F02.1.454.light.4.raw

SEQ ID NO: 589712 - DNA, 519 bp, Homo sapiens
  misc_feature: HIJSMM301EAZIO.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggaccgaacggtaggaagtacgaagacgaactacgtaggctggtcaccactacctcgtcttctactcttcccgt

SEQ ID NO: 589713 - DNA, 504 bp, Homo sapiens
  misc_feature: HIJSMM301B05FP.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcagtccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccacct

SEQ ID NO: 589714 - DNA, 416 bp, Homo sapiens; identical to SEQ ID NO: 545902
  misc_feature: HIJSMM301DTCA6.18.78.H01.1.454.light.4.raw

SEQ ID NO: 589715 - DNA, 479 bp, Homo sapiens; identical to SEQ ID NO: 537141
  misc_feature: HIJSMM301B0L5W.7.76.G10.1.454.light.4.raw

SEQ ID NO: 589716 - DNA, 500 bp, Homo sapiens; identical to SEQ ID NO: 542309
  misc_feature: HIJSMM301B3LYU.12.86.H09.1.454.light.4.raw

SEQ ID NO: 589717 - DNA, 491 bp, Homo sapiens; identical to SEQ ID NO: 579645
  misc_feature: HIJSMM301AK03S.19.71.G05.1.454.light.4.raw

SEQ ID NO: 589718 - DNA, 500 bp, Homo sapiens
  misc_feature: HIJSMM301BSN86.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccgccctcctcgcacgtaga

SEQ ID NO: 589719 - DNA, 498 bp, Homo sapiens
  misc_feature: HIJSMM301BX1GW.17.25.C03.1.454.light.4.raw
  modified_base (483)..(483): a, c, t, g, unknown or other
cgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcaacggcgttaaaaacctatttaaattggtatcagcagaaacctggaaaagccccagacctcctgatctctggtgcatccactctgcgaagtggcgtcccatcgaggttcagtggcagtggatctgggacagatttcaaatctcaccatcaccactctgcaaacctgaggattgtgcaatctactactgtcaaacagagttacagttcccctcgcaacttttgcagggaccaaagttgagatcaaaacgaaactagtggntgcacccaatctgtt

SEQ ID NO: 589720 - DNA, 503 bp, Homo sapiens
  misc_feature: HIJSMM301D0P70.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcact

SEQ ID NO: 589721 - DNA, 500 bp, Homo sapiens
  misc_feature: HIJSMM301A7AES.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggacgaaggtagagatcaaaggaacgtagtggctgcaccatctgtcttcatcttcccg

SEQ ID NO: 589722 - DNA, 501 bp, Homo sapiens
  misc_feature: HIJSMM301DAF9Q.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaaacggtcacattggccatcagtggagtccaggcagaggacgaggctgactattattgtcaatcaacagacaccattggtacttatgtcttcggaactgcgccaaggtcaccgtcctgggtcaggcccaaaggccaaaccccacctactcactctcg

SEQ ID NO: 589723 - DNA, 488 bp, Homo sapiens; identical to SEQ ID NO: 535990
  misc_feature: HIJSMM301C2HOA.11.28.C06.1.454.light.4.raw

SEQ ID NO: 589724 - DNA, 510 bp, Homo sapiens; identical to SEQ ID NO: 537122
  misc_feature: HIJSMM301C4JE3.17.2.A02.1.454.light.4.raw

SEQ ID NO: 589725 - DNA, 506 bp, Homo sapiens; identical to SEQ ID NO: 565966
  misc_feature: HIJSMM301DMCUJ.19.85.H08.1.454.light.4.raw

SEQ ID NO: 589726 - DNA, 513 bp, Homo sapiens
  misc_feature: HIJSMM301ALQVK.49.18.B07.1.454.light.4.raw
agtcgagagacacgaccggtgctcgatttagtcgctgcgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtcctaggtcagcccaaggctcgccccctcggtcactctgttcccaccctcctctct

SEQ ID NO: 589727 - DNA, 483 bp, Homo sapiens
  misc_feature: HIJSMM301DP06W.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatacaaacgaactgtggctgcaccatctgtcttcatcttcccgccatctgagctacg

SEQ ID NO: 589728 - DNA, 477 bp, Homo sapiens; identical to SEQ ID NO: 535506
  misc_feature: HIJSMM301ETCND.7.67.G01.1.454.light.4.raw

SEQ ID NO: 589729 - DNA, 495 bp, Homo sapiens; identical to SEQ ID NO: 535712
  misc_feature: HIJSMM301AS8JP.27.78.H01.1.454.light.4.raw

SEQ ID NO: 589730 - DNA, 488 bp, Homo sapiens
  misc_feature: HIJSMM301CSDIE.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaacggtggaaatacaaacgaacctagtggctgcacca

SEQ ID NO: 589731 - DNA, 509 bp, Homo sapiens; identical to SEQ ID NO: 539359
  misc_feature: HIJSMM301ESF15.47.85.H08.1.454.light.4.raw

SEQ ID NO: 589732 - DNA, 498 bp, Homo sapiens; identical to SEQ ID NO: 548660
  misc_feature: HIJSMM301CQDPU.43.71.G05.1.454.light.4.raw

SEQ ID NO: 589733 - DNA, 521 bp, Homo sapiens
  misc_feature: HIJSMM301EJNAO.15.57.F02.1.454.light.4.raw
  modified_base (513)..(513): a, c, t, g, unknown or other
tctacgtagccacgaccggtgctcgatttagctcgatatagttgggtttggggggggtcgtcaggaggcagcgctctcaggacatctccaccatggcctgggctctgctgctcctcaccctccctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcgggcggagggaccaagctgaccgtcctaggtcagcccaaggctcgccccctccggtnactcttcg

SEQ ID NO: 589734 - DNA, 441 bp, Homo sapiens; identical to SEQ ID NO: 534971
  misc_feature: HIJSMM301AR184.11.3.A03.1.454.light.4.raw

SEQ ID NO: 589735 - DNA, 510 bp, Homo sapiens; identical to SEQ ID NO: 556652
  misc_feature: HIJSMM301CDE6D.17.28.C06.1.454.light.4.raw

SEQ ID NO: 589736 - DNA, 503 bp, Homo sapiens
  misc_feature: HIJSMM301D4STA.5.86.H09.1.454.light.4.raw
atcagacacgcacgaccggtgctcgatttagtgctatagacttggggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctgataccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggt

SEQ ID NO: 589737 - DNA, 510 bp, Homo sapiens
  misc_feature: HIJSMM301DDWEX.48.20.B09.1.454.light.4.raw
agtatacatacacgaccggtgctcgatttagtgtagtgtgaagggtgaggaggagaggggagcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggagtaattatgtatcctggttccagcagttcccaggaacagcccccaaactcctcattcatgacactaataagcgaccctcaggcattcctgaccgattctctggctccaagtctggcacgtcagccaccctgggcatcaccggactccagactggggacgaggccgattattactgcggaacatgggaaggcagcctgagtgctacccagtgggtgttcggcggagggaccaagctgaccgtcctaggtcagcccaaggctcgccccctcggtctacc

SEQ ID NO: 589738 - DNA, 495 bp, Homo sapiens
  misc_feature: HIJSMM301CUDXO.13.11.A11.1.454.light.4.raw
tcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacacagcgtgctgttcggcggagggaccagtctgaccgtcttaggtcagcccaaggctgccccctcggtcactctcgttcccta

SEQ ID NO: 589739 - DNA, 488 bp, Homo sapiens; identical to SEQ ID NO: 542175
  misc_feature: HIJSMM301EPK2G.48.27.C05.1.454.light.4.raw

SEQ ID NO: 589740 - DNA, 485 bp, Homo sapiens
  misc_feature: HIJSMM301AUVYY.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgtgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccat

SEQ ID NO: 589741 - DNA, 509 bp, Homo sapiens
  misc_feature: HIJSMM301D4RZ8.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaggaccgaacggtaggaagtacaacgaacagtggctgcaccatctgtcttcactcttcccgtcccact

SEQ ID NO: 589742 - DNA, 507 bp, Homo sapiens
  misc_feature: HIJSMM301AYB25.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcaactttcggcggagggaccaaggtggagatcaaacgaactgtggctgcaccatctgtt

SEQ ID NO: 589743 - DNA, 521 bp, Homo sapiens; identical to SEQ ID NO: 538715
  misc_feature: HIJSMM301BUTJP.27.23.C01.1.454.light.4.raw

SEQ ID NO: 589744 - DNA, 494 bp, Homo sapiens; identical to SEQ ID NO: 555761
  misc_feature: HIJSMM301CKZ38.48.1.A01.1.454.light.4.raw

SEQ ID NO: 589745 - DNA, 496 bp, Homo sapiens
  misc_feature: HIJSMM301A1MJR.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggcagcagtggtaacattgtgatattcggcggagggaccaaggtgaccgtcctacgtcagcccaaggctgccccctcggtcactctcg

SEQ ID NO: 589746 - DNA, 488 bp, Homo sapiens; identical to SEQ ID NO: 535990
  misc_feature: HIJSMM301DFDG4.11.28.C06.1.454.light.4.raw

SEQ ID NO: 589747 - DNA, 498 bp, Homo sapiens
  misc_feature: HIJSMM301BY209.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtctacgtcacgcccaaggctcg

SEQ ID NO: 589748 - DNA, 484 bp, Homo sapiens; identical to SEQ ID NO: 551212
  misc_feature: HIJSMM301ELM6G.3.10.A10.1.454.light.4.raw

SEQ ID NO: 589749 - DNA, 484 bp, Homo sapiens; identical to SEQ ID NO: 535400
  misc_feature: HIJSMM301AWAFL.46.26.C04.1.454.light.4.raw

SEQ ID NO: 589750 - DNA, 514 bp, Homo sapiens
  misc_feature: HIJSMM301ER7OL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaactccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaaacgaacctagtggcgtcgcaccatctgttcttctatcttccccg

SEQ ID NO: 589751 - DNA, 447 bp, Homo sapiens; identical to SEQ ID NO: 535020
  misc_feature: HIJSMM301B79GD.18.9.A09.1.454.light.4.raw

SEQ ID NO: 589752 - DNA, 489 bp, Homo sapiens
  misc_feature: HIJSMM301BGQIV.3.72.G06.1.454.light.4.raw
agacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgt

SEQ ID NO: 589753 - DNA, 487 bp, Homo sapiens; identical to SEQ ID NO: 546164
  misc_feature: HIJSMM301ARYSW.5.6.A06.1.454.light.4.raw

SEQ ID NO: 589754 - DNA, 499 bp, Homo sapiens
  misc_feature: HIJSMM301DGGM7.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcacatctgtcttcatcttcccgccta

SEQ ID NO: 589755 - DNA, 509 bp, Homo sapiens
  misc_feature: HIJSMM301BSF7O.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaaactgtggctgcaccatctgtcttcta

SEQ ID NO: 589756 - DNA, 506 bp, Homo sapiens; identical to SEQ ID NO: 539303
  misc_feature: HIJSMM301D08XB.8.19.B08.1.454.light.4.raw

SEQ ID NO: 589757 - DNA, 494 bp, Homo sapiens
  misc_feature: HIJSMM301CTE7M.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgaggtgattattactgcagctcatatagaagtggcagcactctcgtattcggcggtgggaccaagctgaccgtcctaggtcagcccaaggctgcccctc

SEQ ID NO: 589758 - DNA, 489 bp, Homo sapiens
  misc_feature: HIJSMM301CIFX6.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtctt

SEQ ID NO: 589759 - DNA, 494 bp, Homo sapiens; identical to SEQ ID NO: 534994
  misc_feature: HIJSMM301CLQ89.27.78.H01.1.454.light.4.raw

SEQ ID NO: 589760 - DNA, 481 bp, Homo sapiens; identical to SEQ ID NO: 535061
  misc_feature: HIJSMM301EQC57.16.81.H04.1.454.light.4.raw

SEQ ID NO: 589761 - DNA, 496 bp, Homo sapiens
  misc_feature: HIJSMM301CXBLP.51.81.H04.1.454.light.4.raw
  modified_base (231)..(231): a, c, t, g, unknown or other
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 589762 - DNA, 502 bp, Homo sapiens
  misc_feature: HIJSMM301ERLQQ.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtctaggtcagcccaaggctgccccctc

SEQ ID NO: 589763 - DNA, 500 bp, Homo sapiens
  misc_feature: HIJSMM301ELQXY.48.57.F02.1.454.light.4.raw
agtatacatacacgaccggtgctcgatttagctcgatatagttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatgggcccaggtgacgatgaggctgactactactgttcctcaacagacagtagtggtgatcgagggctgttcggcggagggaccaagctgaccgtcctaagtcagcccaaggctgccccctcggtcactctgtt

SEQ ID NO: 589764 - DNA, 522 bp, Homo sapiens
  misc_feature: HIJSMM301BFXRG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccagggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccggtcctaggtcagcccaaggctgccccctcggtcactctcgttcccaccctt

SEQ ID NO: 589765 - DNA, 480 bp, Homo sapiens
  misc_feature: HIJSMM301BAB5Z.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgcctcctccgtactctctcgctcgtagcgggccgtggtcgaacggacggccgataagt

SEQ ID NO: 589766 - DNA, 444 bp, Homo sapiens; identical to SEQ ID NO: 535027
  misc_feature: HIJSMM301A7FJ6.8.73.G07.1.454.light.4.raw

SEQ ID NO: 589767 - DNA, 477 bp, Homo sapiens
  misc_feature: HIJSMM301EK5X0.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccagggctgaccgtcct

SEQ ID NO: 589768 - DNA, 504 bp, Homo sapiens
  misc_feature: HIJSMM301B5BOD.27.78.H01.1.454.light.4.raw
  modified_base (444)..(444): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcanagtactactttacctcaagtgatcaccttcggccaagggacacgactggagattaaaacg

SEQ ID NO: 589769 - DNA, 475 bp, Homo sapiens; identical to SEQ ID NO: 566557
  misc_feature: HIJSMM301AVHM2.40.23.C01.1.454.light.4.raw

SEQ ID NO: 589770 - DNA, 489 bp, Homo sapiens; identical to SEQ ID NO: 535091
  misc_feature: HIJSMM301DZMBD.47.36.D03.1.454.light.4.raw

SEQ ID NO: 589771 - DNA, 506 bp, Homo sapiens
  misc_feature: HIJSMM301COC2D.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgatttattactgcagctcatattcaggcagcaacagggtattcggcggagggaccaagttgaccgtctaggtcagcccaaggctgccccctcggcactctgttcccacct

SEQ ID NO: 589772 - DNA, 487 bp, Homo sapiens; identical to SEQ ID NO: 537079
  misc_feature: HIJSMM301BJU87.14.55.E11.1.454.light.4.raw

SEQ ID NO: 589773 - DNA, 499 bp, Homo sapiens
  misc_feature: HIJSMM301CVCPC.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacgggaccgaaggtacggaaagtacaaacgaaacctagtggcgtcgcaccaa

SEQ ID NO: 589774 - DNA, 518 bp, Homo sapiens; identical to SEQ ID NO: 545878
  misc_feature: HIJSMM301AZXD2.41.25.C03.1.454.light.4.raw

SEQ ID NO: 589775 - DNA, 382 bp, Homo sapiens
  misc_feature: HIJSMM301CY7YD.41.25.C03.1.454.light.4.raw
tctatactatcacgaccggtgctcgatttagtagtgtagatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgcatctgaatagtataga

SEQ ID NO: 589776 - DNA, 506 bp, Homo sapiens
  misc_feature: HIJSMM301CN5WB.3.37.D04.1.454.light.4.raw
agacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgatttattactgcagctcatttacaagcagcaccactcaggtcttcggaactgggactaaggtcaccgtctaggtcagcccaaggccaacccactgtcact

SEQ ID NO: 589777 - DNA, 505 bp, Homo sapiens; identical to SEQ ID NO: 546412
  misc_feature: HIJSMM301BAXNN.22.21.B10.1.454.light.4.raw

SEQ ID NO: 589778 - DNA, 502 bp, Homo sapiens; identical to SEQ ID NO: 543132
  misc_feature: HIJSMM301C9WLE.17.28.C06.1.454.light.4.raw

SEQ ID NO: 589779 - DNA, 516 bp, Homo sapiens
  misc_feature: HIJSMM301AEQOB.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccacgggaccgaaggtaggaaggtacaaacgaacgtagtaggcgtgcaccactctgtcttctactcttcccgtccc

SEQ ID NO: 589780 - DNA, 499 bp, Homo sapiens
  misc_feature: HIJSMM301DIQG9.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaagggaccgaaggtggatagtcagacgaactgtgggctg

SEQ ID NO: 589781 - DNA, 473 bp, Homo sapiens
  misc_feature: HIJSMM301EW2DL.49.8.A08.1.454.light.4.raw
agtcgagagacacgaccggtgctcgatttagcatactctacaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcacttcggcggagggaccaaggtggagatcaaacgaaactgtggcg

SEQ ID NO: 589782 - DNA, 487 bp, Homo sapiens
  misc_feature: HIJSMM301D8L87.43.15.B04.1.454.light.4.raw
tgtgagtagtcacgaccggtgctcgatttagacagtatatatccgcggggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaacgcccctaaactcctgatctatgctgcatccaggttgcagagtggggtcccatcaagattcagcggcagtggatctgggacagatttcactctcactatcagcagcctgcagcctgaagtattttgccacttactattgtcaacaggctgactacgtttccccttctaccttcggccaagggacacgactggacaattaaacgaactgtgctgcaccta

SEQ ID NO: 589783 - DNA, 504 bp, Homo sapiens
  misc_feature: HIJSMM301AID3C.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccgccctcctcctacgtctat

SEQ ID NO: 589784 - DNA, 513 bp, Homo sapiens
  misc_feature: HIJSMM301A5D39.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgtcgtcgacggaccgaacggtaggaagtacgaacgaacgtagtggcgtgcaccactctgtcttctactcttcccgtccact

SEQ ID NO: 589785 - DNA, 504 bp, Homo sapiens; identical to SEQ ID NO: 542288
  misc_feature: HIJSMM301EA71Z.8.28.C06.1.454.light.4.raw

SEQ ID NO: 589786 - DNA, 497 bp, Homo sapiens; identical to SEQ ID NO: 545672
  misc_feature: HIJSMM301B20QF.2.49.E05.1.454.light.4.raw

SEQ ID NO: 589787 - DNA, 495 bp, Homo sapiens; identical to SEQ ID NO: 536931
  misc_feature: HIJSMM301A4WMB.10.33.C11.1.454.light.4.raw

SEQ ID NO: 589788 - DNA, 504 bp, Homo sapiens
  misc_feature: HIJSMM301AUJBU.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctcggggccactttcggcctgggaccaaggtggagatcaaacgaactgtggctgcaccatctgtcttcta

SEQ ID NO: 589789 - DNA, 491 bp, Homo sapiens
  misc_feature: HIJSMM301C8G34.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccaagggaccagggtggaaagtacaagcgaactgtggctgcaccatctgtctt

SEQ ID NO: 589790 - DNA, 494 bp, Homo sapiens
  misc_feature: HIJSMM301DY2K7.43.83.H06.1.454.light.4.raw
tgtgagtagtcacgaccggtgctcgatttagatcacgtgcgtcgcggggagagctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcaatggccatgggtctgggacggagttcactctcaccatcagccgactggagcctgaagattttgcagtatattactgtcaacaatatggtagttctcctctcactttcggcggagggaccaaggtggaagtcaaacgaactgtggctgcaccatctgtcttcatt

SEQ ID NO: 589791 - DNA, 503 bp, Homo sapiens; identical to SEQ ID NO: 551912
  misc_feature: HIJSMM301AMDZF.12.50.E06.1.454.light.4.raw

SEQ ID NO: 589792 - DNA, 463 bp, Homo sapiens; identical to SEQ ID NO: 535062
  misc_feature: HIJSMM301AL3RX.11.73.G07.1.454.light.4.raw

SEQ ID NO: 589793 - DNA, 496 bp, Homo sapiens; identical to SEQ ID NO: 535423
  misc_feature: HIJSMM301EVF8J.3.33.C11.1.454.light.4.raw

SEQ ID NO: 589794 - DNA, 518 bp, Homo sapiens
  misc_feature: HIJSMM301B24AX.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagccctccctggccatcagtgggctccgggtccgaggatgaggctgattattactgtgcagcatgggatgacagcctgagtggtccttgggtgttcggcggagggaccaagctgaccgtcctaagtcagcccaaggctgccccctcggtcactctcgttcccaccctcctcg

SEQ ID NO: 589795 - DNA, 506 bp, Homo sapiens
  misc_feature: HIJSMM301C59FN.48.73.G07.1.454.light.4.raw
  modified_base (418)..(418): a, c, t, g, unknown or other
agtatacatacacgaccggtgctcgatttagctctacgctcagggcacgaccggtgctcgatttagtcgctgcgtaaaggagaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaanctgaagatgctgcaacctattactgtcatcagaccttttagttacgtcggaccttcggccaagggacacgactggagattaaacgtaa

SEQ ID NO: 589796 - DNA, 484 bp, Homo sapiens; identical to SEQ ID NO: 540581
  misc_feature: HIJSMM301DI3PE.3.88.H11.1.454.light.4.raw

SEQ ID NO: 589797 - DNA, 495 bp, Homo sapiens
  misc_feature: HIJSMM301AKE5J.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccactgtcact

SEQ ID NO: 589798 - DNA, 484 bp, Homo sapiens; identical to SEQ ID NO: 550726
  misc_feature: HIJSMM301C2WN5.47.62.F07.1.454.light.4.raw

SEQ ID NO: 589799 - DNA, 480 bp, Homo sapiens
  misc_feature: HIJSMM301BLRAC.51.61.F06.1.454.light.4.raw
cgatcgtatacacgaccggtgctcgatttagctacgctctaagggaaagggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttactactgtcaacagagttacggtaccctgctcactttcggcggaggaccaaggtggagatcaaacgaactgtggctgcacc

SEQ ID NO: 589800 - DNA, 497 bp, Homo sapiens; identical to SEQ ID NO: 536371
  misc_feature: HIJSMM301D6NAH.16.78.H01.1.454.light.4.raw

SEQ ID NO: 589801 - DNA, 498 bp, Homo sapiens
  misc_feature: HIJSMM301C857R.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccca

SEQ ID NO: 589802 - DNA, 454 bp, Homo sapiens; identical to SEQ ID NO: 534964
  misc_feature: HIJSMM301D6KWF.19.86.H09.1.454.light.4.raw

SEQ ID NO: 589803 - DNA, 503 bp, Homo sapiens
  misc_feature: HIJSMM301EC96R.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaaacgaactgtggctgcaccatctgttctt

SEQ ID NO: 589804 - DNA, 518 bp, Homo sapiens; identical to SEQ ID NO: 561292
  misc_feature: HIJSMM301ETFUT.22.30.C08.1.454.light.4.raw
  modified_base (507)..(507): a, c, t, g, unknown or other

SEQ ID NO: 589805 - DNA, 506 bp, Homo sapiens
  misc_feature: HIJSMM301D3O8U.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcatgggacncaacatgggatgacaatctgagcggttgggtgttcggcggagggaccaaacgtgaccgtcctagggtcaggaccccg

SEQ ID NO: 589806 - DNA, 507 bp, Homo sapiens
  misc_feature: HIJSMM301DHRA8.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaagagattttgtaagggaagtaatgaagttaa

SEQ ID NO: 589807 - DNA, 489 bp, Homo sapiens; identical to SEQ ID NO: 535139
  misc_feature: HIJSMM301DZCN4.14.55.E11.1.454.light.4.raw

SEQ ID NO: 589808 - DNA, 485 bp, Homo sapiens; identical to SEQ ID NO: 536576
  misc_feature: HIJSMM301COSWE.46.35.D02.1.454.light.4.raw

SEQ ID NO: 589809 - DNA, 514 bp, Homo sapiens
  misc_feature: HIJSMM301A6MGO.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagccggtgcctccgtgtctgggtctcctggacagtcgatcaccatctcctgcactggaaccagcagtgatggttgggggttataaccttgtctcctggtaccaacagcaaccaggcaaagcccccaaactttggtttatcagggcaataagcggccctcaggggtttctaatcgcttctctggctccaagtctggcaacacggccgccctgacaatctctgggctccaggctgacgacgaggctgatttttactgctgctcatatgcaggtgatctacacttttatgttcgggactgggaccaaggtcacgtcctaggtcagcccaaggccaacccactgtcactctccg

SEQ ID NO: 589810 - DNA, 508 bp, Homo sapiens
  misc_feature: HIJSMM301CHLVL.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactagtggctgcaccatctgtcttcta

SEQ ID NO: 589811 - DNA, 469 bp, Homo sapiens
  misc_feature: HIJSMM301D46IP.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtctaacaggctaacagtttccctccgacctcgccaggacacgactggagataaacgaa

SEQ ID NO: 589812 - DNA, 519 bp, Homo sapiens
  misc_feature: HIJSMM301DL6UQ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcactcttccccg

SEQ ID NO: 589813 - DNA, 502 bp, Homo sapiens
  misc_feature: HIJSMM301BE751.4.6.A06.1.454.light.4.raw
agcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctgccccctc

SEQ ID NO: 589814 - DNA, 440 bp, Homo sapiens; identical to SEQ ID NO: 536696
  misc_feature: HIJSMM301DL5ES.11.3.A03.1.454.light.4.raw

SEQ ID NO: 589815 - DNA, 485 bp, Homo sapiens; identical to SEQ ID NO: 536263
  misc_feature: HIJSMM301B63SE.47.78.H01.1.454.light.4.raw

SEQ ID NO: 589816 - DNA, 485 bp, Homo sapiens
  misc_feature: HIJSMM301DNP2U.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtgaggctgaggatgttggggtttattactgcatgcaagttctacaaacttcctacacttttggccaggggaccaagctggagatcaaacga

SEQ ID NO: 589817 - DNA, 508 bp, Homo sapiens; identical to SEQ ID NO: 564177
  misc_feature: HIJSMM301ASX9W.17.28.C06.1.454.light.4.raw

SEQ ID NO: 589818 - DNA, 511 bp, Homo sapiens; identical to SEQ ID NO: 537464
  misc_feature: HIJSMM301BRWA4.7.34.D01.1.454.light.4.raw

SEQ ID NO: 589819 - DNA, 479 bp, Homo sapiens; identical to SEQ ID NO: 536050
  misc_feature: HIJSMM301C95OX.5.73.G07.1.454.light.4.raw

SEQ ID NO: 589820 - DNA, 486 bp, Homo sapiens
  misc_feature: HIJSMM301B524M.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtatctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 589821 - DNA, 518 bp, Homo sapiens
  misc_feature: HIJSMM301ELDRX.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtcgttcggcggggggaccaagctgaccgtcctaggtcagcccaaggctgccccctcggtcactctgttcccaccctcctcagacgtatctac

SEQ ID NO: 589822 - DNA, 502 bp, Homo sapiens; identical to SEQ ID NO: 541971
  misc_feature: HIJSMM301EGYEW.4.39.D06.1.454.light.4.raw

SEQ ID NO: 589823 - DNA, 521 bp, Homo sapiens
  misc_feature: HIJSMM301ARKHL.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccgaaggtgaccgtcctaagtcagcccaaggctgccccctcggtcactctgttcccaccct

SEQ ID NO: 589824 - DNA, 499 bp, Homo sapiens
  misc_feature: HIJSMM301C7XKR.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaagggtgaccgtcctacgtcagcccaaggctgccccctcggtcactctccg

SEQ ID NO: 589825 - DNA, 515 bp, Homo sapiens
  misc_feature: HIJSMM301C6L61.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtggggacagtaatagtgatcccgagcaggttttcggcggtgggaccaagctgaccgtcctaagtcagcccaaggctgccccctggtccactctgttccccg

SEQ ID NO: 589826 - DNA, 502 bp, Homo sapiens; identical to SEQ ID NO: 536253
  misc_feature: HIJSMM301BV9HI.21.22.B11.1.454.light.4.raw

SEQ ID NO: 589827 - DNA, 501 bp, Homo sapiens
  misc_feature: HIJSMM301E2PUE.48.25.C03.1.454.light.4.raw
  modified_base (239)..(239): a, c, t, g, unknown or other
agtatacatacacgaccggtgctcgatttagtagtgtagatttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatntgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcact

SEQ ID NO: 589828 - DNA, 502 bp, Homo sapiens; identical to SEQ ID NO: 562394
  misc_feature: HIJSMM301CE7QS.7.71.G05.1.454.light.4.raw

SEQ ID NO: 589829 - DNA, 490 bp, Homo sapiens
  misc_feature: HIJSMM301DBRYS.5.45.E01.1.454.light.4.raw
atcagacacgcacgaccggtgctcgatttagtgagtcagtaagggaaagggggggcacttctccctctaacactctccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaaagttctaatgctttcccgcgcacgtttggccaggggaccaaggtagagatcaaacgaactgtggctgcaccatctgtcttcatcttcccgccat

SEQ ID NO: 589830 - DNA, 499 bp, Homo sapiens; identical to SEQ ID NO: 536578
  misc_feature: HIJSMM301DKDC4.22.27.C05.1.454.light.4.raw

SEQ ID NO: 589831 - DNA, 486 bp, Homo sapiens; identical to SEQ ID NO: 535385
  misc_feature: HIJSMM301CUKRT.19.71.G05.1.454.light.4.raw

SEQ ID NO: 589832 - DNA, 488 bp, Homo sapiens
  misc_feature: HIJSMM301DRD3H.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaactgtggctgcacatctgtt

SEQ ID NO: 589833 - DNA, 498 bp, Homo sapiens
  misc_feature: HIJSMM301EFJ3M.9.53.E09.1.454.light.4.raw
  modified_base (472)..(472): a, c, t, g, unknown or other
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtnaccggtcctaggtcagcccaaggctg

SEQ ID NO: 589834 - DNA, 483 bp, Homo sapiens; identical to SEQ ID NO: 535413
  misc_feature: HIJSMM301DPGW2.26.78.H01.1.454.light.4.raw

SEQ ID NO: 589835 - DNA, 486 bp, Homo sapiens; identical to SEQ ID NO: 535385
  misc_feature: HIJSMM301DAGOY.19.71.G05.1.454.light.4.raw

SEQ ID NO: 589836 - DNA, 506 bp, Homo sapiens
  misc_feature: HIJSMM301CAIZ1.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggacccaaggtggacctcaaacgaactgtggctgcaccatctgtcttcatcttcccgcc

SEQ ID NO: 589837 - DNA, 488 bp, Homo sapiens; identical to SEQ ID NO: 537260
  misc_feature: HIJSMM301DYVVF.47.70.G04.1.454.light.4.raw

SEQ ID NO: 589838 - DNA, 503 bp, Homo sapiens
  misc_feature: HIJSMM301DX9U8.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggccaaaattgagatcaaacgaactgtggctgcaccatctgtcttcatcttcccgcc

SEQ ID NO: 589839 - DNA, 508 bp, Homo sapiens; identical to SEQ ID NO: 576837
  misc_feature: HIJSMM301EQ8T7.19.78.H01.1.454.light.4.raw

SEQ ID NO: 589840 - DNA, 471 bp, Homo sapiens
  misc_feature: HIJSMM301D82O9.4.79.H02.1.454.light.4.raw
agcactgtagcacgaccggtgctcgatttagtgtcacacgaagggaaaggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctcctcatctctgatgcctccactctgcacggtggcgtcccgccaacgttcagcggcagcggatctgggacagaattcagcctcaccatcagcagcctgcagcctgatgatgttgcaacttactactgtcaacaatataacagttactggacgttcggccaagggaccaaggtggaactacaaacgaactgtgg

SEQ ID NO: 589841 - DNA, 482 bp, Homo sapiens
  misc_feature: HIJSMM301CHEO6.46.26.C04.1.454.light.4.raw
  modified_base (443)..(443): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctattgggttctaatcgggcctcggggtccctgacaggttcagtggcagtggatcaggcacagattttacactgaaaatcagcagagtggaggctgaggatgttgggctctattattgcatgcaagctctacaagtcccgntcactttcggcggagggaccaaggtggagatcaaacgaa

SEQ ID NO: 589842 - DNA, 486 bp, Homo sapiens; identical to SEQ ID NO: 535043
  misc_feature: HIJSMM301A4J96.46.35.D02.1.454.light.4.raw

SEQ ID NO: 589843 - DNA, 489 bp, Homo sapiens; identical to SEQ ID NO: 546040
  misc_feature: HIJSMM301DKAJZ.11.12.B01.1.454.light.4.raw

SEQ ID NO: 589844 - DNA, 511 bp, Homo sapiens; identical to SEQ ID NO: 537464
  misc_feature: HIJSMM301EQI2T.7.34.D01.1.454.light.4.raw

SEQ ID NO: 589845 - DNA, 503 bp, Homo sapiens
  misc_feature: HIJSMM301B3M62.52.31.C09.1.454.light.4.raw
  modified_base (239)..(239): a, c, t, g, unknown or other
cgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaggtcaggccaggcccctatattgatcatctatgaagacagcaaacgacccgctgggatccctcagagattctctggctccagctcagggacaatggccaccttgactatcactggggcccaggtggaggatgaagctgccttcttattgtttttcaacagacagcagtggtaatcatagggtgttcggcggagggaccgaggctcgaccgtcgtacggtcagcccaaggctcggccccctcggt

SEQ ID NO: 589846 - DNA, 509 bp, Homo sapiens; identical to SEQ ID NO: 553073
  misc_feature: HIJSMM301DGM15.16.1.A01.1.454.light.4.raw

SEQ ID NO: 589847 - DNA, 506 bp, Homo sapiens; identical to SEQ ID NO: 535058
  misc_feature: HIJSMM301ASH1X.17.41.D08.1.454.light.4.raw

SEQ ID NO: 589848 - DNA, 484 bp, Homo sapiens
  misc_feature: HIJSMM301ETMH1.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggcctaggggaccaagctggagatcaagcgaactgtggctgcaccat

SEQ ID NO: 589849 - DNA, 504 bp, Homo sapiens
  misc_feature: HIJSMM301BL2DE.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtgtacacccctcactttcggcggaggggccaaggtggagatcaagcgaactgtggctgcaccatctgtcttcatcttcccgc

SEQ ID NO: 589850 - DNA, 500 bp, Homo sapiens
  misc_feature: HIJSMM301E262A.48.4.A04.1.454.light.4.raw
agtatacatacacgaccggtgctcgatttagagtagtgatcaggggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggccccctaacctcctgatctacggtacatccactttgcaaagtggggtcccctcaaggttcagcggcagtggctcttggacggatttcactctcaccatcaccagtcttcaggctgaagatttaggaattttacactgtcagcagacttacagtgttccgtacacttttgggccaggggaccaaaactggagatgaaacgaactgtggctgcaccatctgtcttcatccttccccg

SEQ ID NO: 589851 - DNA, 499 bp, Homo sapiens; identical to SEQ ID NO: 536030
  misc_feature: HIJSMM301C4S75.48.23.C01.1.454.light.4.raw

SEQ ID NO: 589852 - DNA, 467 bp, Homo sapiens
  misc_feature: HIJSMM301DI0GY.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccgaaacgtggatgtcaacgaa

SEQ ID NO: 589853 - DNA, 500 bp, Homo sapiens
  misc_feature: HIJSMM301DKS8T.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgcccctcggtcactc

SEQ ID NO: 589854 - DNA, 516 bp, Homo sapiens
  misc_feature: HIJSMM301EULQU.49.55.E11.1.454.light.4.raw
  modified_base (472)..(472): a, c, t, g, unknown or other
agtcgagagacacgaccggtgctcgatttagcactcgcacgttgggtttgggggtgctcgatttagtctagcgactttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgacgtactattgttactcaccagacaccatgaaaatcanagaggaatattcggcggagggacaagctgaccgtcctaggtcag

SEQ ID NO: 589855 - DNA, 490 bp, Homo sapiens; identical to SEQ ID NO: 536909
  misc_feature: HIJSMM301DKNJ4.12.27.C05.1.454.light.4.raw

SEQ ID NO: 589856 - DNA, 493 bp, Homo sapiens
  misc_feature: HIJSMM301C056M.27.78.H01.1.454.light.4.raw
  modified_base (462)..(462): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaacgaactgtgctgcaccatctgtctt

SEQ ID NO: 589857 - DNA, 447 bp, Homo sapiens; identical to SEQ ID NO: 535020
  misc_feature: HIJSMM301CRIBF.18.9.A09.1.454.light.4.raw

SEQ ID NO: 589858 - DNA, 491 bp, Homo sapiens; identical to SEQ ID NO: 535294
  misc_feature: HIJSMM301AXBFK.16.68.G02.1.454.light.4.raw

SEQ ID NO: 589859 - DNA, 494 bp, Homo sapiens
  misc_feature: HIJSMM301A41MJ.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggtttgttcctccatgcaaggtacacactggccttttggccaggggaccaaacctggagatcaaaatgaactgtggctgcaccatctgtctt

SEQ ID NO: 589860 - DNA, 454 bp, Homo sapiens; identical to SEQ ID NO: 535005
  misc_feature: HIJSMM301EJLZC.19.86.H09.1.454.light.4.raw

SEQ ID NO: 589861 - DNA, 526 bp, Homo sapiens
  misc_feature: HIJSMM301EM5BD.41.25.C03.1.454.light.4.raw
tctatactatcacgaccggtgctcgatttagtagtgtagatttgggtttgggggagtagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagctagctatgtgcagtggttccagcagcgcccgggcagttctcccgtcactctaatttatgaagattttcgaagactccctgggtcccctttcggttttctggctccatcgacagtccctccaactccgcctcccttaccatatctgggctgaagagtgaggacggggctgactacttctgtcagtcttatgatataaacaattaatgtgataatttggcggagggaccagggtgaccgtcctaggtcagcccaaggctgccccctcggtcactctgttcccgtccct

SEQ ID NO: 589862 - DNA, 487 bp, Homo sapiens; identical to SEQ ID NO: 582184
  misc_feature: HIJSMM301AJJWS.46.34.D01.1.454.light.4.raw

SEQ ID NO: 589863 - DNA, 416 bp, Homo sapiens; identical to SEQ ID NO: 539343
  misc_feature: HIJSMM301EPD5S.18.78.H01.1.454.light.4.raw

SEQ ID NO: 589864 - DNA, 521 bp, Homo sapiens; identical to SEQ ID NO: 539470
  misc_feature: HIJSMM301DMWCS.27.23.C01.1.454.light.4.raw

SEQ ID NO: 589865 - DNA, 475 bp, Homo sapiens
  misc_feature: HIJSMM301B7X4I.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgaagatgttgcaacttattactgtacaaaagtataacagtcgcccccttcaccttcggccaagggacacgactggagattagaacg

SEQ ID NO: 589866 - DNA, 498 bp, Homo sapiens
  misc_feature: HIJSMM301CND7J.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtggaaatcaaaacgaactagtggctgcaccatctgtcttcatt

SEQ ID NO: 589867 - DNA, 502 bp, Homo sapiens
  misc_feature: HIJSMM301BNU7P.41.14.B03.1.454.light.4.raw
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 589868 - DNA, 518 bp, Homo sapiens
  misc_feature: HIJSMM301DT2X9.27.23.C01.1.454.light.4.raw
  modified_base (515)..(515): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgtcccncct

SEQ ID NO: 589869 - DNA, 492 bp, Homo sapiens; identical to SEQ ID NO: 544236
  misc_feature: HIJSMM301ER7EJ.12.23.C01.1.454.light.4.raw

SEQ ID NO: 589870 - DNA, 504 bp, Homo sapiens
  misc_feature: HIJSMM301ER1LY.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaatcaaacgaactgtggctgcaccatctgtcttcatcttccgcc

SEQ ID NO: 589871 - DNA, 490 bp, Homo sapiens; identical to SEQ ID NO: 535420
  misc_feature: HIJSMM301DIZN9.3.72.G06.1.454.light.4.raw

SEQ ID NO: 589872 - DNA, 490 bp, Homo sapiens; identical to SEQ ID NO: 569075
  misc_feature: HIJSMM301ANVEN.19.57.F02.1.454.light.4.raw

SEQ ID NO: 589873 - DNA, 511 bp, Homo sapiens
  misc_feature: HIJSMM301BNMNX.9.12.B01.1.454.light.4.raw
  modified_base (424)..(424): a, c, t, g, unknown or other
  modified_base (431)..(431): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaaacngttttcncgggcgttcgccgaacggaccgaaggtaggaaatacaaacgaactagtggctcgcaccactctgtcttcatccttccccg

SEQ ID NO: 589874 - DNA, 502 bp, Homo sapiens
  misc_feature: HIJSMM301BLS5J.11.31.C09.1.454.light.4.raw
cgagagataccacgaccggtgctcgatttagacgtctcatcaaggaaggaaggggcagcaagatggtagttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 589875 - DNA, 526 bp, Homo sapiens
  misc_feature: HIJSMM301B9FCV.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtccgtgggcccactctgtgctgactcagccaccctcagcgtctcgggacccccgggcagagggtcaccatctcttgttctggaagcacctccaacatcggaagtaatcctgtaaactggttccagcaactcccaggaagggcccccaaacgtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaaggttgaccgtccgtcgggtcagccccgaaggccttcgccccccttccgggtcacctctcgttccccct

SEQ ID NO: 589876 - DNA, 514 bp, Homo sapiens; identical to SEQ ID NO: 540552
  misc_feature: HIJSMM301EP234.16.66.F11.1.454.light.4.raw

SEQ ID NO: 589877 - DNA, 493 bp, Homo sapiens; identical to SEQ ID NO: 538916
  misc_feature: HIJSMM301BCIJG.27.78.H01.1.454.light.4.raw

SEQ ID NO: 589878 - DNA, 494 bp, Homo sapiens
  misc_feature: HIJSMM301AJ1HQ.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgacttgggttttattctactttcggccctcgggaccaaagtggatttcagacgaactgtggctgcaccatctgtcttcta

SEQ ID NO: 589879 - DNA, 494 bp, Homo sapiens
  misc_feature: HIJSMM301CQWAN.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcact

SEQ ID NO: 589880 - DNA, 505 bp, Homo sapiens; identical to SEQ ID NO: 567023
  misc_feature: HIJSMM301ETSVX.10.27.C05.1.454.light.4.raw

SEQ ID NO: 589881 - DNA, 491 bp, Homo sapiens
  misc_feature: HIJSMM301DKJHR.52.25.C03.1.454.light.4.raw
cgcagtacgacacgaccggtgctcgatttagtagtgtagatttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaaacaccttaatagttactccttcacttttcggcccttgggaccaaaagtggacatcaaacgaactgtggctgcaccatctgtctt

SEQ ID NO: 589882 - DNA, 500 bp, Homo sapiens
  misc_feature: HIJSMM301D0XZR.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccac

SEQ ID NO: 589883 - DNA, 505 bp, Homo sapiens; identical to SEQ ID NO: 551129
  misc_feature: HIJSMM301BWPHH.18.78.H01.1.454.light.4.raw

SEQ ID NO: 589884 - DNA, 517 bp, Homo sapiens
  misc_feature: HIJSMM301CKDGX.12.71.G05.1.454.light.4.raw
  modified_base (495)..(495): a, c, t, g, unknown or other
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagccaaggctgcccccnccggtcactctgttcccaccct

SEQ ID NO: 589885 - DNA, 515 bp, Homo sapiens; identical to SEQ ID NO: 555401
  misc_feature: HIJSMM301CJXHM.15.34.D01.1.454.light.4.raw

SEQ ID NO: 589886 - DNA, 507 bp, Homo sapiens; identical to SEQ ID NO: 536226
  misc_feature: HIJSMM301CMR2V.18.37.D04.1.454.light.4.raw

SEQ ID NO: 589887 - DNA, 476 bp, Homo sapiens; identical to SEQ ID NO: 536632
  misc_feature: HIJSMM301AVGBD.52.1.A01.1.454.light.4.raw

SEQ ID NO: 589888 - DNA, 467 bp, Homo sapiens; identical to SEQ ID NO: 537890
  misc_feature: HIJSMM301B2WI8.3.68.G02.1.454.light.4.raw

SEQ ID NO: 589889 - DNA, 494 bp, Homo sapiens
  misc_feature: HIJSMM301BSF70.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcaccttttcacttttcggcggagggaccaaggtggagagcagacgaactgtggctgcacc

SEQ ID NO: 589890 - DNA, 498 bp, Homo sapiens
  misc_feature: HIJSMM301C7FNR.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggcccatcagtgggctccggtccgaggatgaggctgattattactgtgttggatgggacagcagcctgagtgcttatgtcttcggaactgggaccacggtcaccgtcct

SEQ ID NO: 589891 - DNA, 434 bp, Homo sapiens; identical to SEQ ID NO: 535153
  misc_feature: HIJSMM301AW8NC.18.5.A05.1.454.light.4.raw

SEQ ID NO: 589892 - DNA, 371 bp, Homo sapiens
  misc_feature: HIJSMM301CELAI.40.9.A09.1.454.light.4.raw
tctagcgactcacgaccggtgctcgatttagcgagacgcgcaggggacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcacca

SEQ ID NO: 589893 - DNA, 483 bp, Homo sapiens
  misc_feature: HIJSMM301DW53N.52.23.C01.1.454.light.4.raw
cgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagcgaactgtggctgcaccat

SEQ ID NO: 589894 - DNA, 500 bp, Homo sapiens
  misc_feature: HIJSMM301BFBSX.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccc

SEQ ID NO: 589895 - DNA, 505 bp, Homo sapiens
  misc_feature: HIJSMM301DIO4O.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgtgcaggaccaaggtggaagtcaagcgaactagtgctgcacactctgtcttcatcttcccgccact

SEQ ID NO: 589896 - DNA, 489 bp, Homo sapiens; identical to SEQ ID NO: 535139
  misc_feature: HIJSMM301CZ4GL.14.55.E11.1.454.light.4.raw

SEQ ID NO: 589897 - DNA, 485 bp, Homo sapiens; identical to SEQ ID NO: 535688
  misc_feature: HIJSMM301D9SPE.19.5.A05.1.454.light.4.raw

SEQ ID NO: 589898 - DNA, 484 bp, Homo sapiens; identical to SEQ ID NO: 537878
  misc_feature: HIJSMM301AUIIK.17.34.D01.1.454.light.4.raw

SEQ ID NO: 589899 - DNA, 489 bp, Homo sapiens; identical to SEQ ID NO: 535139
  misc_feature: HIJSMM301B1G24.14.55.E11.1.454.light.4.raw

SEQ ID NO: 589900 - DNA, 477 bp, Homo sapiens
  misc_feature: HIJSMM301DG9JP.51.67.G01.1.454.light.4.raw
cgatcgtatacacgaccggtgctcgatttagagtatacatattgggtttggggaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaaggtggaggatcaagcgaacgtgt

SEQ ID NO: 589901 - DNA, 449 bp, Homo sapiens; identical to SEQ ID NO: 545037
  misc_feature: HIJSMM301DSE8M.40.14.B03.1.454.light.4.raw

SEQ ID NO: 589902 - DNA, 491 bp, Homo sapiens; identical to SEQ ID NO: 536211
  misc_feature: HIJSMM301CQEXA.16.53.E09.1.454.light.4.raw

SEQ ID NO: 589903 - DNA, 493 bp, Homo sapiens; identical to SEQ ID NO: 536471
  misc_feature: HIJSMM301C2XVT.3.71.G05.1.454.light.4.raw

SEQ ID NO: 589904 - DNA, 496 bp, Homo sapiens; identical to SEQ ID NO: 535423
  misc_feature: HIJSMM301DARHS.3.33.C11.1.454.light.4.raw

SEQ ID NO: 589905 - DNA, 507 bp, Homo sapiens
  misc_feature: HIJSMM301B7YN1.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccaacgtggaaatcaaacgaactgtggctgcaccatctgtcttcta

SEQ ID NO: 589906 - DNA, 494 bp, Homo sapiens
  misc_feature: HIJSMM301CK6LK.41.38.D05.1.454.light.4.raw
tctatactatcacgaccggtgctcgatttagtatctgatagttgggttggggaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcta

SEQ ID NO: 589907 - DNA, 510 bp, Homo sapiens; identical to SEQ ID NO: 566324
  misc_feature: HIJSMM301CVD3X.5.60.F05.1.454.light.4.raw

SEQ ID NO: 589908 - DNA, 488 bp, Homo sapiens; identical to SEQ ID NO: 569586
  misc_feature: HIJSMM301DQN8Y.16.72.G06.1.454.light.4.raw

SEQ ID NO: 589909 - DNA, 482 bp, Homo sapiens; identical to SEQ ID NO: 550464
  misc_feature: HIJSMM301CM4FI.13.50.E06.1.454.light.4.raw

SEQ ID NO: 589910 - DNA, 476 bp, Homo sapiens
  misc_feature: HIJSMM301DO9PI.5.12.B01.1.454.light.4.raw
atcagacacgcacgaccggtgctcgatttagtagtgtagattccgcggggggggtctcaggagacagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgttgattttcggcgggagggaccaagctgaccgt

SEQ ID NO: 589911 - DNA, 498 bp, Homo sapiens; identical to SEQ ID NO: 537020
  misc_feature: HIJSMM301CX7PD.26.26.C04.1.454.light.4.raw

SEQ ID NO: 589912 - DNA, 489 bp, Homo sapiens; identical to SEQ ID NO: 537328
  misc_feature: HIJSMM301D0NOZ.13.5.A05.1.454.light.4.raw

SEQ ID NO: 589913 - DNA, 515 bp, Homo sapiens
  misc_feature: HIJSMM301ECE7O.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccaatggtgcacgcaaagcgggacccagaccctggagcctcagttggaagcagccgatccagcctgcggagcctgtggggcaggtcagcccaaggcctgccccctggtccactctgttcccaccctcctccacg

SEQ ID NO: 589914 - DNA, 511 bp, Homo sapiens; identical to SEQ ID NO: 537464
  misc_feature: HIJSMM301B8RXC.7.34.D01.1.454.light.4.raw

SEQ ID NO: 589915 - DNA, 502 bp, Homo sapiens
  misc_feature: HIJSMM301ATE5F.43.27.C05.1.454.light.4.raw
tgtgagtagtcacgaccggtgctcgatttagacgcgatcgaagggtttggggctccaaacagagcttcagcaaggatagtgggattctgcaccatgcccagggctctgctcctcctgaccctcctcactcactctgcagtgtcagtggtccaggcaggactgactcagccaccctcggtgtccaagtaattgagacacaccgccacactcacctgcgctgggaacaacagtagtgtcgacaatcaaggagcagcttggctgctgcagttcaagagtcagggataacaaaccggccctcagggatctcatagagactatctgcatccaggtcaggaaagacagcctccctgaccattactggactccggcctgaggacgagtctgaccattactgctcaccttggggcagtagtgtcaatactcggggtgttcggcggagggaccaaccggaccgtcctaggtcagcccaaggctgccccctcggtcactctgttcccaccct

SEQ ID NO: 589916 - DNA, 494 bp, Homo sapiens; identical to SEQ ID NO: 542031
  misc_feature: HIJSMM301CG31N.12.23.C01.1.454.light.4.raw

SEQ ID NO: 589917 - DNA, 493 bp, Homo sapiens; identical to SEQ ID NO: 541789
  misc_feature: HIJSMM301BHMNL.26.72.G06.1.454.light.4.raw

SEQ ID NO: 589918 - DNA, 502 bp, Homo sapiens
  misc_feature: HIJSMM301DRVFE.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaatcgaccgtcctaggtcagcccaaggctgccccctc

SEQ ID NO: 589919 - DNA, 518 bp, Homo sapiens; identical to SEQ ID NO: 567809
  misc_feature: HIJSMM301EZOCA.43.81.H04.1.454.light.4.raw

SEQ ID NO: 589920 - DNA, 508 bp, Homo sapiens
  misc_feature: HIJSMM301D47FA.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgcccctcggtcactctgtt

SEQ ID NO: 589921 - DNA, 504 bp, Homo sapiens
  misc_feature: HIJSMM301C0ZDW.53.34.D01.1.454.light.4.raw
cgcgtatacacacgaccggtgctcgatttagatcgtctgtgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactcttccg

SEQ ID NO: 589922 - DNA, 487 bp, Homo sapiens; identical to SEQ ID NO: 536206
  misc_feature: HIJSMM301ENEX0.47.38.D05.1.454.light.4.raw

SEQ ID NO: 589923 - DNA, 504 bp, Homo sapiens
  misc_feature: HIJSMM301D8TAG.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctatctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcggtccact

SEQ ID NO: 589924 - DNA, 506 bp, Homo sapiens; identical to SEQ ID NO: 534969
  misc_feature: HIJSMM301AFZYD.18.37.D04.1.454.light.4.raw

SEQ ID NO: 589925 - DNA, 480 bp, Homo sapiens; identical to SEQ ID NO: 535975
  misc_feature: HIJSMM301DOHCS.51.60.F05.1.454.light.4.raw

SEQ ID NO: 589926 - DNA, 516 bp, Homo sapiens; identical to SEQ ID NO: 562329
  misc_feature: HIJSMM301DDMW3.5.27.C05.1.454.light.4.raw

SEQ ID NO: 589927 - DNA, 505 bp, Homo sapiens; identical to SEQ ID NO: 557888
  misc_feature: HIJSMM301C6UUE.5.24.C02.1.454.light.4.raw

SEQ ID NO: 589928 - DNA, 497 bp, Homo sapiens; identical to SEQ ID NO: 535740
  misc_feature: HIJSMM301C3X53.3.71.G05.1.454.light.4.raw

SEQ ID NO: 589929 - DNA, 496 bp, Homo sapiens
  misc_feature: HIJSMM301CZMUE.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagatttttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatt

SEQ ID NO: 589930 - DNA, 484 bp, Homo sapiens
  misc_feature: HIJSMM301APUW1.16.81.H04.1.454.light.4.raw
  modified_base (447)..(447): a, c, t, g, unknown or other
  modified_base (453)..(453): a, c, t, g, unknown or other
  modified_base (456)..(456): a, c, t, g, unknown or other
  modified_base (473)..(473): a, c, t, g, unknown or other
  modified_base (481)..(481): a, c, t, g, unknown or other
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaaattcactctcaccatcagcagcctacagcctaaatgattttgcgacttattattgcaacagaataagagtattcaacttgtcctcggcggacagtgngtatanaanaaacactaggacgtgcncacactcnctt

SEQ ID NO: 589931 - DNA, 494 bp, Homo sapiens; identical to SEQ ID NO: 534992
  misc_feature: HIJSMM301DAO20.9.1.A01.1.454.light.4.raw

SEQ ID NO: 589932 - DNA, 492 bp, Homo sapiens
  misc_feature: HIJSMM301E2V0I.41.59.F04.1.454.light.4.raw
tctatactatcacgaccggtgctcgatttagtacacacacttagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttatttttgttcaacaggctaataggttccctcaacattcggcctgggaccagagtggatttgaagcgaactgtggctgcaccatctgtt

SEQ ID NO: 589933 - DNA, 443 bp, Homo sapiens
  misc_feature: HIJSMM301BLZ1C.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacttcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgtactctcctcg

SEQ ID NO: 589934 - DNA, 501 bp, Homo sapiens; identical to SEQ ID NO: 548094
  misc_feature: HIJSMM301DXGGA.41.45.E01.1.454.light.4.raw

SEQ ID NO: 589935 - DNA, 490 bp, Homo sapiens; identical to SEQ ID NO: 541141
  misc_feature: HIJSMM301CSBDU.47.38.D05.1.454.light.4.raw

SEQ ID NO: 589936 - DNA, 522 bp, Homo sapiens
  misc_feature: HIJSMM301C0VJK.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtcccactgtgatcttcggcggggggaccggaacgacttgaccgtccttacggtcgacgacccaacggacgttgtcccccccg

SEQ ID NO: 589937 - DNA, 497 bp, Homo sapiens
  misc_feature: HIJSMM301D73I6.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaggtggaaatcaaacgaactgtggctgcacc

SEQ ID NO: 589938 - DNA, 486 bp, Homo sapiens; identical to SEQ ID NO: 535043
  misc_feature: HIJSMM301AYRAI.46.35.D02.1.454.light.4.raw

SEQ ID NO: 589939 - DNA, 441 bp, Homo sapiens; identical to SEQ ID NO: 534971
  misc_feature: HIJSMM301DQA1A.11.3.A03.1.454.light.4.raw

SEQ ID NO: 589940 - DNA, 487 bp, Homo sapiens; identical to SEQ ID NO: 554782
  misc_feature: HIJSMM301A89C8.46.35.D02.1.454.light.4.raw

SEQ ID NO: 589941 - DNA, 477 bp, Homo sapiens; identical to SEQ ID NO: 539277
  misc_feature: HIJSMM301CDGBZ.4.10.A10.1.454.light.4.raw

SEQ ID NO: 589942 - DNA, 485 bp, Homo sapiens
  misc_feature: HIJSMM301A6C7C.49.42.D09.1.454.light.4.raw
agtcgagagacacgaccggtgctcgatttagacacatacgcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccat

SEQ ID NO: 589943 - DNA, 514 bp, Homo sapiens; identical to SEQ ID NO: 554167
  misc_feature: HIJSMM301CL01W.40.12.B01.1.454.light.4.raw

SEQ ID NO: 589944 - DNA, 490 bp, Homo sapiens; identical to SEQ ID NO: 535064
  misc_feature: HIJSMM301CEHHJ.10.72.G06.1.454.light.4.raw

SEQ ID NO: 589945 - DNA, 463 bp, Homo sapiens; identical to SEQ ID NO: 535062
  misc_feature: HIJSMM301ETWGI.11.73.G07.1.454.light.4.raw

SEQ ID NO: 589946 - DNA, 490 bp, Homo sapiens
  misc_feature: HIJSMM301D67TH.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactaatgtcaacagacttacagtgccccccgatcaccttcggccaagggacacgactggagattaaacgaactgtggctgcaccatctgtcttcatt

SEQ ID NO: 589947 - DNA, 511 bp, Homo sapiens
  misc_feature: HIJSMM301CH11V.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcacgggtcgaagccggggatgaggccgactattactgtcaggtgtgggatagtagtggtgatcatccatacgtcttcggaactgggaccaaggtctccgtcctacgtcagcccaaggccaaccccactgtcactctgttcccta

SEQ ID NO: 589948 - DNA, 486 bp, Homo sapiens
  misc_feature: HIJSMM301AG65L.46.26.C04.1.454.light.4.raw
actagcagtacacgaccggtgctcgatttagtctagcgactttgggtttgggggtgatcaggactcctcagttcaccttctcacaatgaggctccctgctcagctcctggggctgctaatggctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 589949 - DNA, 446 bp, Homo sapiens; identical to SEQ ID NO: 538346
  misc_feature: HIJSMM301EG4B2.18.9.A09.1.454.light.4.raw

SEQ ID NO: 589950 - DNA, 493 bp, Homo sapiens; identical to SEQ ID NO: 543205
  misc_feature: HIJSMM301DMM1J.51.6.A06.1.454.light.4.raw

SEQ ID NO: 589951 - DNA, 354 bp, Homo sapiens; identical to SEQ ID NO: 535026
  misc_feature: HIJSMM301ETPPT.19.22.B11.1.454.light.4.raw

SEQ ID NO: 589952 - DNA, 471 bp, Homo sapiens
  misc_feature: HIJSMM301A9F74.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctcactccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgt

SEQ ID NO: 589953 - DNA, 498 bp, Homo sapiens; identical to SEQ ID NO: 547944
  misc_feature: HIJSMM301AJGWD.41.53.E09.1.454.light.4.raw

SEQ ID NO: 589954 - DNA, 504 bp, Homo sapiens
  misc_feature: HIJSMM301DGT01.43.55.E11.1.454.light.4.raw
tgtgagtagtcacgaccggtgctcgatttagcactcgcacgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccccg

SEQ ID NO: 589955 - DNA, 493 bp, Homo sapiens; identical to SEQ ID NO: 536471
  misc_feature: HIJSMM301CL8SI.3.71.G05.1.454.light.4.raw

SEQ ID NO: 589956 - DNA, 354 bp, Homo sapiens; identical to SEQ ID NO: 535026
  misc_feature: HIJSMM301B1H1U.19.22.B11.1.454.light.4.raw

SEQ ID NO: 589957 - DNA, 493 bp, Homo sapiens
  misc_feature: HIJSMM301BAK9I.4.5.A05.1.454.light.4.raw
agcactgtagcacgaccggtgctcgatttagatagatagacagggggaggaactgctcagttaggacccagacggaaccatggaagccccagcgcagcttctcttcctcctgctactctggctcccagataccactggagaaatagtgatgacccagtctccagccaccctgtctgtgtctccaggggaaagagccaccctctcctgcagggccagtcagagtgttgacggcaacttagcctggtaccagcagaaacctggccaggctcccagactcctcatctacggtccatccactagggccactggtgtcccacccaggttcagtggcagtggatctgggacagagttcactctcaccatcagtagcctgcagtctgaagattttgcacttttatttctgtcagcaatataataactggcctccttcaagcagttttggccaggggaccaagctggagatcaaacgaactgtggctgcaccatctgtctt

SEQ ID NO: 589958 - DNA, 491 bp, Homo sapiens; identical to SEQ ID NO: 535294
  misc_feature: HIJSMM301BI97Z.16.68.G02.1.454.light.4.raw

SEQ ID NO: 589959 - DNA, 489 bp, Homo sapiens; identical to SEQ ID NO: 543840
  misc_feature: HIJSMM301CMS4T.12.88.H11.1.454.light.4.raw

SEQ ID NO: 589960 - DNA, 499 bp, Homo sapiens
  misc_feature: HIJSMM301DK2I6.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccacgggaccgaccggtcggagtggtctaagcgaaacctgtggcgtgcgaccaactcttcg

SEQ ID NO: 589961 - DNA, 495 bp, Homo sapiens
  misc_feature: HIJSMM301DTWJT.3.14.B03.1.454.light.4.raw
agacgcactccacgaccggtgctcgatttagtgtgagtagtcccgcggaactactcacacccatggcctggaccgttctcctcctcggcctcctctctcactgcacaggctctgtgacctcctatgtgctgactcagccaccctcggtgtcagtggccccaggaaagacggccaggattacctgtgggggaaacaaaattggagataaaagtgtgcactggtaccagcagaagccaggccaggcccctgtgctggtcatccattctgatagcgaccgcccctcagggatcccctgagcgattctctggctccaactctgcgaacacggccaccctgaccatcagcagggtcgaagccggggatgaggccgactattcttgtcaggtgtgggatagtagtactgtgatattcggcggagggaccaagctgaccgtcctaggtcagcccaaggctgccccctcggtcactctcgttcccaccctcctgagtgcgtct

SEQ ID NO: 589962 - DNA, 511 bp, Homo sapiens; identical to SEQ ID NO: 549861
  misc_feature: HIJSMM301BMRRN.19.59.F04.1.454.light.4.raw

SEQ ID NO: 589963 - DNA, 504 bp, Homo sapiens; identical to SEQ ID NO: 551974
  misc_feature: HIJSMM301BAZ1C.19.78.H01.1.454.light.4.raw

SEQ ID NO: 589964 - DNA, 408 bp, Homo sapiens; identical to SEQ ID NO: 547850
  misc_feature: HIJSMM301AHF21.43.24.C02.1.454.light.4.raw

SEQ ID NO: 589965 - DNA, 497 bp, Homo sapiens
  misc_feature: HIJSMM301EGRH6.16.78.H01.1.454.light.4.raw
tgtactactccacgaccggtgctcgatttagtgtgagtagtttgggtttgggggaggaactgctcagttaggacccagacgggaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 589966 - DNA, 494 bp, Homo sapiens
  misc_feature: HIJSMM301DU36G.5.35.D02.1.454.light.4.raw
atcagacacgcacgaccggtgctcgatttagcacacgatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacacgtggatatcaggcgaactgtggctgcaccatctgtcttcta

SEQ ID NO: 589967 - DNA, 447 bp, Homo sapiens; identical to SEQ ID NO: 535201
  misc_feature: HIJSMM301CCBQU.18.9.A09.1.454.light.4.raw

SEQ ID NO: 589968 - DNA, 434 bp, Homo sapiens; identical to SEQ ID NO: 535153
  misc_feature: HIJSMM301ENS1D.18.5.A05.1.454.light.4.raw

SEQ ID NO: 589969 - DNA, 496 bp, Homo sapiens; identical to SEQ ID NO: 561995
  misc_feature: HIJSMM301E4AMH.16.78.H01.1.454.light.4.raw

SEQ ID NO: 589970 - DNA, 508 bp, Homo sapiens; identical to SEQ ID NO: 550253
  misc_feature: HIJSMM301AMOZF.9.55.E11.1.454.light.4.raw

SEQ ID NO: 589971 - DNA, 486 bp, Homo sapiens
  misc_feature: HIJSMM301BH0B3.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttatattgtcaacaatattattatacttcgtggacgttcggccaagggaccaaggtggatatcagacgaa

SEQ ID NO: 589972 - DNA, 494 bp, Homo sapiens
  misc_feature: HIJSMM301AGHRX.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttggttcctccatgcaaggtacacactggccttttggccaggggaccaacctggagatcaaatgaactgtggctgcaccatctgtctt

SEQ ID NO: 589973 - DNA, 505 bp, Homo sapiens; identical to SEQ ID NO: 535503
  misc_feature: HIJSMM301BASAZ.8.28.C06.1.454.light.4.raw

SEQ ID NO: 589974 - DNA, 481 bp, Homo sapiens
  misc_feature: HIJSMM301BO63M.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgttttgggtgttcgggcggagggacc

SEQ ID NO: 589975 - DNA, 482 bp, Homo sapiens; identical to SEQ ID NO: 536622
  misc_feature: HIJSMM301ECZ3H.7.85.H08.1.454.light.4.raw

SEQ ID NO: 589976 - DNA, 472 bp, Homo sapiens
  misc_feature: HIJSMM301BT0DJ.13.76.G10.1.454.light.4.raw
  modified_base (430)..(430): a, c, t, g, unknown or other
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgntatgtcttcggaactgggaccaaggtcaccgtcctaagtcag

SEQ ID NO: 589977 - DNA, 488 bp, Homo sapiens
  misc_feature: HIJSMM301DN6LZ.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtcctccacacctcctgatttacgaagtttccaaccgcttcgctggactgccagataggttcagtggcagcgggtcagggacagattttacacttgaaaatcagccgggtggaggctggaggacgttggaattttattactgtatgcaaggtatagagcttcctccgacgttcgccaaggaccaaggtgaactcaaacgaa

SEQ ID NO: 589978 - DNA, 494 bp, Homo sapiens; identical to SEQ ID NO: 534992
  misc_feature: HIJSMM301DC8TY.9.1.A01.1.454.light.4.raw

SEQ ID NO: 589979 - DNA, 493 bp, Homo sapiens; identical to SEQ ID NO: 540127
  misc_feature: HIJSMM301EY4SY.10.17.B06.1.454.light.4.raw

SEQ ID NO: 589980 - DNA, 505 bp, Homo sapiens
  misc_feature: HIJSMM301EDO70.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttatattgtcagcagcgtagcaggtggcctttcactttcggcccggggaccaaagtggaaatcaaacgaactgtggctgcaccatctgtcttcatcttcccgc

SEQ ID NO: 589981 - DNA, 448 bp, Homo sapiens; identical to SEQ ID NO: 567223
  misc_feature: HIJSMM301A3KWI.18.9.A09.1.454.light.4.raw

SEQ ID NO: 589982 - DNA, 505 bp, Homo sapiens; identical to SEQ ID NO: 536254
  misc_feature: HIJSMM301ERVGN.7.71.G05.1.454.light.4.raw

SEQ ID NO: 589983 - DNA, 496 bp, Homo sapiens; identical to SEQ ID NO: 535109
  misc_feature: HIJSMM301CBKZX.16.78.H01.1.454.light.4.raw

SEQ ID NO: 589984 - DNA, 521 bp, Homo sapiens; identical to SEQ ID NO: 538715
  misc_feature: HIJSMM301AR7AD.27.23.C01.1.454.light.4.raw

SEQ ID NO: 589985 - DNA, 502 bp, Homo sapiens
  misc_feature: HIJSMM301D52DS.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgaccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 589986 - DNA, 479 bp, Homo sapiens
  misc_feature: HIJSMM301BYHIB.48.35.D02.1.454.light.4.raw
agtatacatacacgaccggtgctcgatttagcacacgatagttgggtttggggggatacgcgtgacagataagaagggctggtgggatcagtcctggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagt

SEQ ID NO: 589987 - DNA, 518 bp, Homo sapiens; identical to SEQ ID NO: 554776
  misc_feature: HIJSMM301DIQ8D.43.81.H04.1.454.light.4.raw

SEQ ID NO: 589988 - DNA, 495 bp, Homo sapiens
  misc_feature: HIJSMM301AN0L2.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagtattttggaacttattattgtcaacgagggtaacacgtttcccgctcaccttcgggcggagggaccaaggtggagatagaaaagaactgtggctgccaccat

SEQ ID NO: 589989 - DNA, 504 bp, Homo sapiens; identical to SEQ ID NO: 538940
  misc_feature: HIJSMM301EFJQ6.2.35.D02.1.454.light.4.raw

SEQ ID NO: 589990 - DNA, 502 bp, Homo sapiens
  misc_feature: HIJSMM301ELN72.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctc

SEQ ID NO: 589991 - DNA, 444 bp, Homo sapiens; identical to SEQ ID NO: 535594
  misc_feature: HIJSMM301CA954.9.9.A09.1.454.light.4.raw

SEQ ID NO: 589992 - DNA, 496 bp, Homo sapiens
  misc_feature: HIJSMM301AVRKH.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaggtcacgtcctaggtcagcccaaggccaacccgactgtcactc

SEQ ID NO: 589993 - DNA, 486 bp, Homo sapiens; identical to SEQ ID NO: 535043
  misc_feature: HIJSMM301DWVT5.46.35.D02.1.454.light.4.raw

SEQ ID NO: 589994 - DNA, 502 bp, Homo sapiens
  misc_feature: HIJSMM301B0O61.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtctac

SEQ ID NO: 589995 - DNA, 489 bp, Homo sapiens
  misc_feature: HIJSMM301B0XN9.48.41.D08.1.454.light.4.raw
agtatacatacacgaccggtgctcgatttagtcacgcgagaaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 589996 - DNA, 504 bp, Homo sapiens
  misc_feature: HIJSMM301DK7UA.43.14.B03.1.454.light.4.raw
tgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcacttatgtcttcggaactgggaccaaggtcaccgcctaggtccagacccaaggcccaaccccactgtca

SEQ ID NO: 589997 - DNA, 494 bp, Homo sapiens; identical to SEQ ID NO: 534992
  misc_feature: HIJSMM301EEDKQ.9.1.A01.1.454.light.4.raw

SEQ ID NO: 589998 - DNA, 496 bp, Homo sapiens; identical to SEQ ID NO: 535109
  misc_feature: HIJSMM301DTRV0.16.78.H01.1.454.light.4.raw

SEQ ID NO: 589999 - DNA, 485 bp, Homo sapiens; identical to SEQ ID NO: 549638
  misc_feature: HIJSMM301ESEHT.49.81.H04.1.454.light.4.raw

SEQ ID NO: 590000 - DNA, 520 bp, Homo sapiens; identical to SEQ ID NO: 539176
  misc_feature: HIJSMM301C1XX3.27.23.C01.1.454.light.4.raw

SEQ ID NO: 590001 - DNA, 483 bp, Homo sapiens
  misc_feature: HIJSMM301B3GLX.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcatgccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggcctcgccccctcggt

SEQ ID NO: 590002 - DNA, 487 bp, Homo sapiens; identical to SEQ ID NO: 539157
  misc_feature: HIJSMM301ENNYH.26.37.D04.1.454.light.4.raw

SEQ ID NO: 590003 - DNA, 507 bp, Homo sapiens; identical to SEQ ID NO: 535641
  misc_feature: HIJSMM301A8LPP.10.88.H11.1.454.light.4.raw

SEQ ID NO: 590004 - DNA, 486 bp, Homo sapiens; identical to SEQ ID NO: 554021
  misc_feature: HIJSMM301BGIVR.40.83.H06.1.454.light.4.raw

SEQ ID NO: 590005 - DNA, 496 bp, Homo sapiens; identical to SEQ ID NO: 538149
  misc_feature: HIJSMM301CK6JE.13.67.G01.1.454.light.4.raw

SEQ ID NO: 590006 - DNA, 479 bp, Homo sapiens; identical to SEQ ID NO: 553343
  misc_feature: HIJSMM301EA8X4.43.12.B01.1.454.light.4.raw

SEQ ID NO: 590007 - DNA, 503 bp, Homo sapiens
  misc_feature: HIJSMM301AOOGT.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactagtggcgtgcaccatctgtcttcatctttccccg

SEQ ID NO: 590008 - DNA, 517 bp, Homo sapiens; identical to SEQ ID NO: 563049
  misc_feature: HIJSMM301DFK1P.13.55.E11.1.454.light.4.raw

SEQ ID NO: 590009 - DNA, 501 bp, Homo sapiens; identical to SEQ ID NO: 573085
  misc_feature: HIJSMM301EEC4V.48.78.H01.1.454.light.4.raw

SEQ ID NO: 590010 - DNA, 493 bp, Homo sapiens
  misc_feature: HIJSMM301EQNQ3.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatggttggggtttattactgcgtgcaaagtctgcaaactatcaccttcggccaagggacacgactggagattaaacgaactgtgctgcacc

SEQ ID NO: 590011 - DNA, 488 bp, Homo sapiens; identical to SEQ ID NO: 535861
  misc_feature: HIJSMM301CT8D4.14.55.E11.1.454.light.4.raw

SEQ ID NO: 590012 - DNA, 494 bp, Homo sapiens
  misc_feature: HIJSMM301CU4EF.41.37.D04.1.454.light.4.raw
tctatactatcacgaccggtgctcgatttagtagcatactgttgggtttgggggcaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtctt

SEQ ID NO: 590013 - DNA, 514 bp, Homo sapiens; identical to SEQ ID NO: 540552
  misc_feature: HIJSMM301BNTG9.16.66.F11.1.454.light.4.raw

SEQ ID NO: 590014 - DNA, 495 bp, Homo sapiens; identical to SEQ ID NO: 535964
  misc_feature: HIJSMM301AESGS.16.10.A10.1.454.light.4.raw

SEQ ID NO: 590015 - DNA, 506 bp, Homo sapiens
  misc_feature: HIJSMM301DI2SJ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggaaccaaactggaccgtcctaggtccagcccaa

SEQ ID NO: 590016 - DNA, 501 bp, Homo sapiens
  misc_feature: HIJSMM301CJ9L1.19.86.H09.1.454.light.4.raw
tactctcgtgcacgaccggtgctcgatttagtgctatagacttgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctc

SEQ ID NO: 590017 - DNA, 503 bp, Homo sapiens
  misc_feature: HIJSMM301AUUQP.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 590018 - DNA, 496 bp, Homo sapiens; identical to SEQ ID NO: 535541
  misc_feature: HIJSMM301B1MYS.3.33.C11.1.454.light.4.raw

SEQ ID NO: 590019 - DNA, 484 bp, Homo sapiens; identical to SEQ ID NO: 535441
  misc_feature: HIJSMM301A6JBA.26.60.F05.1.454.light.4.raw

SEQ ID NO: 590020 - DNA, 488 bp, Homo sapiens
  misc_feature: HIJSMM301DLWO0.41.2.A02.1.454.light.4.raw
tctatactatcacgaccggtgctcgatttagactcatctacagggggcaggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtctt

SEQ ID NO: 590021 - DNA, 494 bp, Homo sapiens; identical to SEQ ID NO: 534992
  misc_feature: HIJSMM301EQFO5.9.1.A01.1.454.light.4.raw

SEQ ID NO: 590022 - DNA, 507 bp, Homo sapiens
  misc_feature: HIJSMM301CUNEA.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatcgggatgacaatctgagcggttgggtggttcggcggagggaccaaactgaccgtcctaggtcagcccaa

SEQ ID NO: 590023 - DNA, 492 bp, Homo sapiens; identical to SEQ ID NO: 573597
  misc_feature: HIJSMM301EPW4T.10.72.G06.1.454.light.4.raw

SEQ ID NO: 590024 - DNA, 501 bp, Homo sapiens; identical to SEQ ID NO: 535746
  misc_feature: HIJSMM301D07NP.18.11.A11.1.454.light.4.raw

SEQ ID NO: 590025 - DNA, 498 bp, Homo sapiens
  misc_feature: HIJSMM301BOM31.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctcgcccc

SEQ ID NO: 590026 - DNA, 487 bp, Homo sapiens; identical to SEQ ID NO: 536536
  misc_feature: HIJSMM301BNENY.26.45.E01.1.454.light.4.raw

SEQ ID NO: 590027 - DNA, 497 bp, Homo sapiens
  misc_feature: HIJSMM301A38H4.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggatatcagacgaactagttgctg

SEQ ID NO: 590028 - DNA, 495 bp, Homo sapiens
  misc_feature: HIJSMM301AEYOI.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtcta

SEQ ID NO: 590029 - DNA, 492 bp, Homo sapiens
  misc_feature: HIJSMM301A9VIQ.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtgaaatcaaacgaactgtggctgcaccatctgtt

SEQ ID NO: 590030 - DNA, 497 bp, Homo sapiens; identical to SEQ ID NO: 542618
  misc_feature: HIJSMM301DXKUX.16.46.E02.1.454.light.4.raw

SEQ ID NO: 590031 - DNA, 485 bp, Homo sapiens; identical to SEQ ID NO: 588140
  misc_feature: HIJSMM301CQE0C.46.35.D02.1.454.light.4.raw

SEQ ID NO: 590032 - DNA, 500 bp, Homo sapiens
  misc_feature: HIJSMM301BEYED.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcgacgggacgcaacagtgggatgacaatctgagcggttgggtgttcggcggagggaaccaaatcgaccgtcctaggtca

SEQ ID NO: 590033 - DNA, 482 bp, Homo sapiens
  misc_feature: HIJSMM301CBGL2.46.26.C04.1.454.light.4.raw
  modified_base (392)..(392): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagnggaggctgaggatgttgggctctattattgcatgcaagctctacaagtcccgctcactttcggcgagggaccaaggtgagatcaaacgaa

SEQ ID NO: 590034 - DNA, 494 bp, Homo sapiens; identical to SEQ ID NO: 566621
  misc_feature: HIJSMM301CQXH8.12.23.C01.1.454.light.4.raw

SEQ ID NO: 590035 - DNA, 504 bp, Homo sapiens; identical to SEQ ID NO: 589668
  misc_feature: HIJSMM301DS9KB.48.8.A08.1.454.light.4.raw

SEQ ID NO: 590036 - DNA, 484 bp, Homo sapiens; identical to SEQ ID NO: 535400
  misc_feature: HIJSMM301DMG80.46.26.C04.1.454.light.4.raw

SEQ ID NO: 590037 - DNA, 509 bp, Homo sapiens
  misc_feature: HIJSMM301CNZTI.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccaaggctgccccctcggtcactctcgttcccg

SEQ ID NO: 590038 - DNA, 495 bp, Homo sapiens
  misc_feature: HIJSMM301BSKH5.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggggaccgaaggtggagatcaaacgaactgtggctgcaccatctgtt

SEQ ID NO: 590039 - DNA, 489 bp, Homo sapiens; identical to SEQ ID NO: 535139
  misc_feature: HIJSMM301CNIY0.14.55.E11.1.454.light.4.raw

SEQ ID NO: 590040 - DNA, 484 bp, Homo sapiens; identical to SEQ ID NO: 535998
  misc_feature: HIJSMM301B7KB8.3.10.A10.1.454.light.4.raw

SEQ ID NO: 590041 - DNA, 496 bp, Homo sapiens; identical to SEQ ID NO: 548177
  misc_feature: HIJSMM301DCI1V.18.59.F04.1.454.light.4.raw

SEQ ID NO: 590042 - DNA, 520 bp, Homo sapiens
  misc_feature: HIJSMM301C2EGZ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatagacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccacct

SEQ ID NO: 590043 - DNA, 477 bp, Homo sapiens
  misc_feature: HIJSMM301ADACM.52.83.H06.1.454.light.4.raw
cgcagtacgacacgaccggtgctcgatttagatcacgtgcgtcgcgggggagtcagtcccaaccaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagagtggggtcccatcaaggttcagcggcagtggatctgggagacaattcactctcacaatcagcagcctgcagcctgaagattttgcgacttattactgtcaacaacttaatcgttaccctcttttcggccctgggaccaaagtggatatcaaacgaactgtggctgcaccat

SEQ ID NO: 590044 - DNA, 518 bp, Homo sapiens
  misc_feature: HIJSMM301BEDAF.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaacgcggggacccagaccctggagcctcagttggaagcagccgatccagcctgcggagcctgtggggcaggtcagcccaaggccaacccactgtcactctcg

SEQ ID NO: 590045 - DNA, 494 bp, Homo sapiens; identical to SEQ ID NO: 534992
  misc_feature: HIJSMM301CZ5PF.9.1.A01.1.454.light.4.raw

SEQ ID NO: 590046 - DNA, 487 bp, Homo sapiens
  misc_feature: HIJSMM301CHN4E.49.55.E11.1.454.light.4.raw
agtcgagagacacgaccggtgctcgatttagcactcgcacgttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaacg

SEQ ID NO: 590047 - DNA, 494 bp, Homo sapiens; identical to SEQ ID NO: 534994
  misc_feature: HIJSMM301BAL9Y.27.78.H01.1.454.light.4.raw

SEQ ID NO: 590048 - DNA, 485 bp, Homo sapiens; identical to SEQ ID NO: 534977
  misc_feature: HIJSMM301DKWCJ.15.28.C06.1.454.light.4.raw

SEQ ID NO: 590049 - DNA, 491 bp, Homo sapiens; identical to SEQ ID NO: 554635
  misc_feature: HIJSMM301EF1M6.43.33.C11.1.454.light.4.raw

SEQ ID NO: 590050 - DNA, 475 bp, Homo sapiens
  misc_feature: HIJSMM301AD2KP.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtggctgca

SEQ ID NO: 590051 - DNA, 478 bp, Homo sapiens
  misc_feature: HIJSMM301BJHRG.49.28.C06.1.454.light.4.raw
agtcgagagacacgaccggtgctcgatttagagctcacgtattgggtttggggagagctctggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaa

SEQ ID NO: 590052 - DNA, 522 bp, Homo sapiens
  misc_feature: HIJSMM301AMFPI.43.67.G01.1.454.light.4.raw
tgtgagtagtcacgaccggtgctcgatttagagtatacatattgggtttgggcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccggtcggtaaac

SEQ ID NO: 590053 - DNA, 494 bp, Homo sapiens; identical to SEQ ID NO: 534994
  misc_feature: HIJSMM301A9D00.27.78.H01.1.454.light.4.raw

SEQ ID NO: 590054 - DNA, 513 bp, Homo sapiens; identical to SEQ ID NO: 545752
  misc_feature: HIJSMM301C13E7.17.33.C11.1.454.light.4.raw

SEQ ID NO: 590055 - DNA, 494 bp, Homo sapiens; identical to SEQ ID NO: 538796
  misc_feature: HIJSMM301DJGX8.48.44.D11.1.454.light.4.raw

SEQ ID NO: 590056 - DNA, 493 bp, Homo sapiens; identical to SEQ ID NO: 548342
  misc_feature: HIJSMM301BJM82.27.78.H01.1.454.light.4.raw

SEQ ID NO: 590057 - DNA, 520 bp, Homo sapiens; identical to SEQ ID NO: 572049
  misc_feature: HIJSMM301B4UNQ.27.23.C01.1.454.light.4.raw

SEQ ID NO: 590058 - DNA, 482 bp, Homo sapiens; identical to SEQ ID NO: 538815
  misc_feature: HIJSMM301AYP7C.4.34.D01.1.454.light.4.raw

SEQ ID NO: 590059 - DNA, 514 bp, Homo sapiens; identical to SEQ ID NO: 544770
  misc_feature: HIJSMM301BS4O2.16.66.F11.1.454.light.4.raw

SEQ ID NO: 590060 - DNA, 493 bp, Homo sapiens; identical to SEQ ID NO: 543949
  misc_feature: HIJSMM301AD5JP.16.68.G02.1.454.light.4.raw

SEQ ID NO: 590061 - DNA, 486 bp, Homo sapiens
  misc_feature: HIJSMM301D88MA.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatcacttttggcaagggaccaagctggagatcaaacgaactgtggctgcacc

SEQ ID NO: 590062 - DNA, 384 bp, Homo sapiens
  misc_feature: HIJSMM301EFD3X.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtactggtagttcacctctaactttcggcggagggaccaaggtggagatcaaacgaactgtggctgcaccatctgtcttcatcttcccgccatctgaatagtataga

SEQ ID NO: 590063 - DNA, 495 bp, Homo sapiens
  misc_feature: HIJSMM301DK955.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggaggatcaaacgaactagtgg

SEQ ID NO: 590064 - DNA, 516 bp, Homo sapiens
  misc_feature: HIJSMM301EOMJH.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctccc

SEQ ID NO: 590065 - DNA, 482 bp, Homo sapiens
  misc_feature: HIJSMM301EZLGX.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgctaatttgaagtattttgactaacttactactgtacaacagtagtttcagttatcccttggacctttcggaccaagggaccaagggtggaaatcaaacgaa

SEQ ID NO: 590066 - DNA, 499 bp, Homo sapiens; identical to SEQ ID NO: 562346
  misc_feature: HIJSMM301AO8Y9.40.81.H04.1.454.light.4.raw

SEQ ID NO: 590067 - DNA, 489 bp, Homo sapiens
  misc_feature: HIJSMM301DRGBG.52.33.C11.1.454.light.4.raw
cgcagtacgacacgaccggtgctcgatttagagtgagctcgttgggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtcttcta

SEQ ID NO: 590068 - DNA, 506 bp, Homo sapiens; identical to SEQ ID NO: 554189
  misc_feature: HIJSMM301ALG8B.19.78.H01.1.454.light.4.raw

SEQ ID NO: 590069 - DNA, 495 bp, Homo sapiens; identical to SEQ ID NO: 538651
  misc_feature: HIJSMM301AUT63.10.79.H02.1.454.light.4.raw

SEQ ID NO: 590070 - DNA, 487 bp, Homo sapiens
  misc_feature: HIJSMM301EN43V.46.35.D02.1.454.light.4.raw
actagcagtacacgaccggtgctcgatttagcacacgatagttgggtttgggggagctgcttcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 590071 - DNA, 506 bp, Homo sapiens; identical to SEQ ID NO: 541085
  misc_feature: HIJSMM301DOUXC.16.46.E02.1.454.light.4.raw

SEQ ID NO: 590072 - DNA, 490 bp, Homo sapiens
  misc_feature: HIJSMM301DNYWA.16.68.G02.1.454.light.4.raw
  modified_base (426)..(426): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtcccatcaaggttcagcggcagtggatctgggacagaattcactctcactatcaccagcctgcaacctgatgattttgcaacttattactgccaacagtatcatcatcattntaatttcggtggagggaccaaggtggaggtcaaacgaactgtggctgcaccatctgtcttcatt

SEQ ID NO: 590073 - DNA, 494 bp, Homo sapiens; identical to SEQ ID NO: 539922
  misc_feature: HIJSMM301CV1ZW.27.78.H01.1.454.light.4.raw

SEQ ID NO: 590074 - DNA, 444 bp, Homo sapiens; identical to SEQ ID NO: 535192
  misc_feature: HIJSMM301AU9AJ.5.9.A09.1.454.light.4.raw

SEQ ID NO: 590075 - DNA, 497 bp, Homo sapiens; identical to SEQ ID NO: 549756
  misc_feature: HIJSMM301BI0EP.40.57.F02.1.454.light.4.raw

SEQ ID NO: 590076 - DNA, 484 bp, Homo sapiens; identical to SEQ ID NO: 535400
  misc_feature: HIJSMM301A6LFS.46.26.C04.1.454.light.4.raw

SEQ ID NO: 590077 - DNA, 486 bp, Homo sapiens; identical to SEQ ID NO: 535043
  misc_feature: HIJSMM301DOODK.46.35.D02.1.454.light.4.raw

SEQ ID NO: 590078 - DNA, 491 bp, Homo sapiens
  misc_feature: HIJSMM301BRRRJ.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtcccatcaaggttcagcggcagtggatctggcacagatttcactctcaccatcagcagcctgcagccttgaagatttcgcaacttattactgtctacaagattacaattaccctggacgttcggtccagggaccgaaggtggaaatacaaacgaactacgtggctcgcacca

SEQ ID NO: 590079 - DNA, 498 bp, Homo sapiens
  misc_feature: HIJSMM301DHBKP.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccgggaccaagtggaaatcaaacgaactgtggctgcaccatctgtcttcatcttcccgccat

SEQ ID NO: 590080 - DNA, 501 bp, Homo sapiens
  misc_feature: HIJSMM301DZX9A.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaagaactgtggctgcaccatctgtcttcatcttccccg

SEQ ID NO: 590081 - DNA, 509 bp, Homo sapiens; identical to SEQ ID NO: 553073
  misc_feature: HIJSMM301BW4W4.16.1.A01.1.454.light.4.raw

SEQ ID NO: 590082 - DNA, 481 bp, Homo sapiens
  misc_feature: HIJSMM301DDTNN.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggaggatcaaacgaactgtggctgcaa

SEQ ID NO: 590083 - DNA, 494 bp, Homo sapiens; identical to SEQ ID NO: 554249
  misc_feature: HIJSMM301DHV5L.10.33.C11.1.454.light.4.raw

SEQ ID NO: 590084 - DNA, 501 bp, Homo sapiens; identical to SEQ ID NO: 536142
  misc_feature: HIJSMM301BS5UQ.15.1.A01.1.454.light.4.raw

SEQ ID NO: 590085 - DNA, 487 bp, Homo sapiens
  misc_feature: HIJSMM301E2AB5.26.23.C01.1.454.light.4.raw
  modified_base (370)..(370): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtgggtcccatcaaggttcagtggcgccggatctgggacagaattcactctcaccatcancgggctccagtctgaggactctgcaacttattactgccaacatatgatatttattcttccagcgttcggccagggaccgaaggtggaagtcaagcgaactgtgcgtgcacatctgtt

SEQ ID NO: 590086 - DNA, 493 bp, Homo sapiens
  misc_feature: HIJSMM301DZT69.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccaggggtggaggatcagacgaactgtggctgcaccatctgtt

SEQ ID NO: 590087 - DNA, 501 bp, Homo sapiens
  misc_feature: HIJSMM301AJM4T.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaatagaggtcaaacgaactagtggtctgcaccatctgtcttc

SEQ ID NO: 590088 - DNA, 494 bp, Homo sapiens; identical to SEQ ID NO: 540110
  misc_feature: HIJSMM301B0XJ5.51.71.G05.1.454.light.4.raw

SEQ ID NO: 590089 - DNA, 486 bp, Homo sapiens; identical to SEQ ID NO: 536323
  misc_feature: HIJSMM301BOEKG.10.2.A02.1.454.light.4.raw

SEQ ID NO: 590090 - DNA, 492 bp, Homo sapiens; identical to SEQ ID NO: 541936
  misc_feature: HIJSMM301B9XOB.47.78.H01.1.454.light.4.raw

SEQ ID NO: 590091 - DNA, 494 bp, Homo sapiens; identical to SEQ ID NO: 557078
  misc_feature: HIJSMM301C95FY.10.17.B06.1.454.light.4.raw

SEQ ID NO: 590092 - DNA, 489 bp, Homo sapiens
  misc_feature: HIJSMM301ATQ5T.14.53.E09.1.454.light.4.raw
cgtctagtaccacgaccggtgctcgatttagagagagtgtgttgggtttggggggggaggcctagctgtgctgtgggtccaggaggcagaactctgggtggtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtccta

SEQ ID NO: 590093 - DNA, 497 bp, Homo sapiens; identical to SEQ ID NO: 536807
  misc_feature: HIJSMM301CYDI8.10.37.D04.1.454.light.4.raw

SEQ ID NO: 590094 - DNA, 460 bp, Homo sapiens; identical to SEQ ID NO: 536053
  misc_feature: HIJSMM301AHWPM.22.28.C06.1.454.light.4.raw

SEQ ID NO: 590095 - DNA, 507 bp, Homo sapiens; identical to SEQ ID NO: 550515
  misc_feature: HIJSMM301EVXL5.12.73.G07.1.454.light.4.raw

SEQ ID NO: 590096 - DNA, 486 bp, Homo sapiens
  misc_feature: HIJSMM301BYWH8.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcgagggaccaaggtggagatcaaacgaactgt

SEQ ID NO: 590097 - DNA, 512 bp, Homo sapiens
  misc_feature: HIJSMM301COZWO.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccaagggaccgaacggtaggaaagtacaagacgaacgtcgtggcgtgcaccatctgtcttctactt

SEQ ID NO: 590098 - DNA, 486 bp, Homo sapiens
  misc_feature: HIJSMM301BO0JA.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatccaccttcggccgggggacacggctggaaactaaacgaactgtggctgcacc

SEQ ID NO: 590099 - DNA, 505 bp, Homo sapiens; identical to SEQ ID NO: 571198
  misc_feature: HIJSMM301AX0NS.5.86.H09.1.454.light.4.raw

SEQ ID NO: 590100 - DNA, 477 bp, Homo sapiens
  misc_feature: HIJSMM301CFP0E.51.70.G04.1.454.light.4.raw
cgatcgtatacacgaccggtgctcgatttagtgtagtgtgaagggaaagggggctcagctcctggggctcctgctgctctggctcccaggtgccagatgtgacatccagttgacccagtctccatccttcctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaaactgtggctgcaccatctgtcttcatcttcccgcccatctgatcgtagcact

SEQ ID NO: 590101 - DNA, 503 bp, Homo sapiens; identical to SEQ ID NO: 536834
  misc_feature: HIJSMM301BL439.2.35.D02.1.454.light.4.raw

SEQ ID NO: 590102 - DNA, 485 bp, Homo sapiens; identical to SEQ ID NO: 541885
  misc_feature: HIJSMM301COJJR.48.54.E10.1.454.light.4.raw

SEQ ID NO: 590103 - DNA, 444 bp, Homo sapiens; identical to SEQ ID NO: 535192
  misc_feature: HIJSMM301A3FUV.5.9.A09.1.454.light.4.raw

SEQ ID NO: 590104 - DNA, 521 bp, Homo sapiens; identical to SEQ ID NO: 539470
  misc_feature: HIJSMM301ED27Q.27.23.C01.1.454.light.4.raw

SEQ ID NO: 590105 - DNA, 486 bp, Homo sapiens
  misc_feature: HIJSMM301CJGWY.19.71.G05.1.454.light.4.raw
  modified_base (479)..(479): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtggatatnagacgaa

SEQ ID NO: 590106 - DNA, 496 bp, Homo sapiens
  misc_feature: HIJSMM301AVYGQ.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatggtagtgccatttctgctgtgttcggaggaggcacccggctgaccgtcctcggtcagcccaaggctgcccc

SEQ ID NO: 590107 - DNA, 508 bp, Homo sapiens
  misc_feature: HIJSMM301AZL19.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtccccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactagtggctgcaccatctgtt

SEQ ID NO: 590108 - DNA, 485 bp, Homo sapiens; identical to SEQ ID NO: 536799
  misc_feature: HIJSMM301CZN4J.19.71.G05.1.454.light.4.raw

SEQ ID NO: 590109 - DNA, 502 bp, Homo sapiens; identical to SEQ ID NO: 541971
  misc_feature: HIJSMM301D2GYB.4.39.D06.1.454.light.4.raw

SEQ ID NO: 590110 - DNA, 499 bp, Homo sapiens
  misc_feature: HIJSMM301EKISJ.48.8.A08.1.454.light.4.raw
agtatacatacacgaccggtgctcgatttagcatactctacagggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaaacaaaaagcctggccaggctcccaggctcctcatctatgatgcatcccatagggccagaggcatcccagccaggttcagtggcagtgggtctggggacagacttcactctcaccatcagcaccctagaacgtgaagattttgcagtttattactgtcagcagtatggtagctcaccgatcaccttcggcaacgggacacgactggagattaaccgaactgtggctgcaccatctgtcttcatcttcccg

SEQ ID NO: 590111 - DNA, 485 bp, Homo sapiens; identical to SEQ ID NO: 535880
  misc_feature: HIJSMM301CFKBZ.7.75.G09.1.454.light.4.raw

SEQ ID NO: 590112 - DNA, 506 bp, Homo sapiens; identical to SEQ ID NO: 541287
  misc_feature: HIJSMM301AEC94.19.78.H01.1.454.light.4.raw

SEQ ID NO: 590113 - DNA, 491 bp, Homo sapiens; identical to SEQ ID NO: 548648
  misc_feature: HIJSMM301EIIR1.10.17.B06.1.454.light.4.raw

SEQ ID NO: 590114 - DNA, 495 bp, Homo sapiens
  misc_feature: HIJSMM301CFY0G.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcaccgtctaggtcagcccaagg

SEQ ID NO: 590115 - DNA, 488 bp, Homo sapiens; identical to SEQ ID NO: 537260
  misc_feature: HIJSMM301A36Q8.47.70.G04.1.454.light.4.raw

SEQ ID NO: 590116 - DNA, 495 bp, Homo sapiens; identical to SEQ ID NO: 538942
  misc_feature: HIJSMM301EO1OF.43.61.F06.1.454.light.4.raw

SEQ ID NO: 590117 - DNA, 493 bp, Homo sapiens
  misc_feature: HIJSMM301BSXB0.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttctacttttggccgaggggaccgaaactggatatcagacgaactgtggctgca

SEQ ID NO: 590118 - DNA, 490 bp, Homo sapiens; identical to SEQ ID NO: 570189
  misc_feature: HIJSMM301BHVGZ.8.4.A04.1.454.light.4.raw

SEQ ID NO: 590119 - DNA, 487 bp, Homo sapiens; identical to SEQ ID NO: 558047
  misc_feature: HIJSMM301D23YU.4.26.C04.1.454.light.4.raw

SEQ ID NO: 590120 - DNA, 492 bp, Homo sapiens; identical to SEQ ID NO: 535426
  misc_feature: HIJSMM301C6X80.47.78.H01.1.454.light.4.raw

SEQ ID NO: 590121 - DNA, 490 bp, Homo sapiens; identical to SEQ ID NO: 562259
  misc_feature: HIJSMM301ANBM3.16.73.G07.1.454.light.4.raw

SEQ ID NO: 590122 - DNA, 497 bp, Homo sapiens
  misc_feature: HIJSMM301DAUV4.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggaggggaccaaggctgaccgtcctaggtcagcccaaggctgccccctcggtcactctgttcccgccctcctcacgtcg

SEQ ID NO: 590123 - DNA, 520 bp, Homo sapiens
  misc_feature: HIJSMM301B1416.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccaaactcattctttatgatgtcagtaatcggcccccaggggtttctgatcgcttcgtatggctccaagtctgcctacacggcctccctgaccatctccgggctccagcctgaggacgaggctgattattattgtagttcatatacaaccagtgacacttgggtgttcggcggaggaccaggctgaccgtcctaggtcagcccaaggctgccccctcggtcactctgttcccgcct

SEQ ID NO: 590124 - DNA, 493 bp, Homo sapiens; identical to SEQ ID NO: 536246
  misc_feature: HIJSMM301BOJKE.49.66.F11.1.454.light.4.raw

SEQ ID NO: 590125 - DNA, 503 bp, Homo sapiens; identical to SEQ ID NO: 543363
  misc_feature: HIJSMM301DHSUN.19.78.H01.1.454.light.4.raw

SEQ ID NO: 590126 - DNA, 488 bp, Homo sapiens; identical to SEQ ID NO: 544442
  misc_feature: HIJSMM301BSVLR.19.57.F02.1.454.light.4.raw

SEQ ID NO: 590127 - DNA, 495 bp, Homo sapiens; identical to SEQ ID NO: 536359
  misc_feature: HIJSMM301DXZN6.48.4.A04.1.454.light.4.raw

SEQ ID NO: 590128 - DNA, 501 bp, Homo sapiens
  misc_feature: HIJSMM301A1WW6.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactctttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccaagggaccagggtggaaatacaaacgaactagtggctgcaccatctgtcttcatcttcccgccact

SEQ ID NO: 590129 - DNA, 497 bp, Homo sapiens; identical to SEQ ID NO: 535286
  misc_feature: HIJSMM301CXU24.18.59.F04.1.454.light.4.raw

SEQ ID NO: 590130 - DNA, 478 bp, Homo sapiens
  misc_feature: HIJSMM301DBJW3.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggacttattctgccagcaatataatagttattggacgttcggccaggggaccaaggtcgaaatgagacgaactgtggctgcacc

SEQ ID NO: 590131 - DNA, 511 bp, Homo sapiens
  misc_feature: HIJSMM301A2XR9.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgtttttaaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccg

SEQ ID NO: 590132 - DNA, 497 bp, Homo sapiens
  misc_feature: HIJSMM301EDPC7.48.35.D02.1.454.light.4.raw
agtatacatacacgaccggtgctcgatttagcacacgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtctaggtcagcccaaggctcg

SEQ ID NO: 590133 - DNA, 512 bp, Homo sapiens
  misc_feature: HIJSMM301BCJYS.9.37.D04.1.454.light.4.raw
tgatacgtctcacgaccggtgctcgatttagtagcatactgttgggtttggggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggaggggaccaagctgaccgtcctaggtcagcccaaggctgccccctcggtcactctgttcccgccctcctcagacgtatca

SEQ ID NO: 590134 - DNA, 523 bp, Homo sapiens
  misc_feature: HIJSMM301AKJX2.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggtcggaggggaccgaacggtagggaggatactaaacgaaacctacgtgggcgtgcaccactactgtt

SEQ ID NO: 590135 - DNA, 499 bp, Homo sapiens; identical to SEQ ID NO: 543922
  misc_feature: HIJSMM301DQEEX.18.11.A11.1.454.light.4.raw

SEQ ID NO: 590136 - DNA, 520 bp, Homo sapiens; identical to SEQ ID NO: 537173
  misc_feature: HIJSMM301EMQRU.27.23.C01.1.454.light.4.raw

SEQ ID NO: 590137 - DNA, 499 bp, Homo sapiens
  misc_feature: HIJSMM301CYTHB.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgcccctcggtcactctgttccaccctcctcgctacgtaga

SEQ ID NO: 590138 - DNA, 441 bp, Homo sapiens; identical to SEQ ID NO: 534971
  misc_feature: HIJSMM301A0YXE.11.3.A03.1.454.light.4.raw

SEQ ID NO: 590139 - DNA, 509 bp, Homo sapiens; identical to SEQ ID NO: 540854
  misc_feature: HIJSMM301EPORD.4.71.G05.1.454.light.4.raw

SEQ ID NO: 590140 - DNA, 483 bp, Homo sapiens
  misc_feature: HIJSMM301DUA1A.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatacaaacgaactgtggctgcaccatctgtt

SEQ ID NO: 590141 - DNA, 486 bp, Homo sapiens
  misc_feature: HIJSMM301AE3ED.49.38.D05.1.454.light.4.raw
agtcgagagacacgaccggtgctcgatttagtatctgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggaggatcaaacg

SEQ ID NO: 590142 - DNA, 513 bp, Homo sapiens; identical to SEQ ID NO: 545177
  misc_feature: HIJSMM301ADAOA.8.23.C01.1.454.light.4.raw

SEQ ID NO: 590143 - DNA, 496 bp, Homo sapiens; identical to SEQ ID NO: 542375
  misc_feature: HIJSMM301B6IKJ.7.59.F04.1.454.light.4.raw

SEQ ID NO: 590144 - DNA, 499 bp, Homo sapiens
  misc_feature: HIJSMM301A7SMA.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgcccctcggtcactc

SEQ ID NO: 590145 - DNA, 515 bp, Homo sapiens
  misc_feature: HIJSMM301EVPQ8.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaagcgggacccagaccctggagcctcagttggaagcagccgatccagcctgcggagcctgtggggcaggtcagcccaaggctgccccctcggtcactctgttcccaccctcctccacg

SEQ ID NO: 590146 - DNA, 491 bp, Homo sapiens; identical to SEQ ID NO: 536211
  misc_feature: HIJSMM301DB3N2.16.53.E09.1.454.light.4.raw

SEQ ID NO: 590147 - DNA, 492 bp, Homo sapiens
  misc_feature: HIJSMM301B1NQ3.19.57.F02.1.454.light.4.raw
tactctcgtgcacgaccggtgctcgatttagctcgatatagttggggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtccctcaaggttcagcggcagtggatctgggacagatttcactctcgccatcagcagcctgcagactgaagattttgctaacttatttttgtcaacaggctaacactttccccctcactttcggcggagggaccaaggtggagatcaagcgaactgtggctgcaccatctgtctt

SEQ ID NO: 590148 - DNA, 499 bp, Homo sapiens
  misc_feature: HIJSMM301BFA9D.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggcccactggtactcccagccaggttcagtggcaggtgggtctgggacagagttcactctcaccatcagcagcctgcagtctgaagtattttgctagtttattactgtcagcagtataataactggttcctgctcactttcgggcgggggaccgaaggtggagatcaaacgaactgtggctgcaccatctgt

SEQ ID NO: 590149 - DNA, 441 bp, Homo sapiens; identical to SEQ ID NO: 550529
  misc_feature: HIJSMM301DHE1I.41.9.A09.1.454.light.4.raw

SEQ ID NO: 590150 - DNA, 484 bp, Homo sapiens; identical to SEQ ID NO: 540581
  misc_feature: HIJSMM301BZ4V9.3.88.H11.1.454.light.4.raw

SEQ ID NO: 590151 - DNA, 497 bp, Homo sapiens; identical to SEQ ID NO: 536371
  misc_feature: HIJSMM301AIDRV.16.78.H01.1.454.light.4.raw

SEQ ID NO: 590152 - DNA, 502 bp, Homo sapiens; identical to SEQ ID NO: 552020
  misc_feature: HIJSMM301CMRJK.49.82.H05.1.454.light.4.raw

SEQ ID NO: 590153 - DNA, 498 bp, Homo sapiens
  misc_feature: HIJSMM301E2S74.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggctgcccctccggt

SEQ ID NO: 590154 - DNA, 480 bp, Homo sapiens; identical to SEQ ID NO: 588469
  misc_feature: HIJSMM301DKNNM.5.70.G04.1.454.light.4.raw

SEQ ID NO: 590155 - DNA, 512 bp, Homo sapiens
  misc_feature: HIJSMM301ATKPX.48.34.D01.1.454.light.4.raw
agtatacatacacgaccggtgctcgatttagatcgtctgtgttgggtttgggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtcccaccctcct

SEQ ID NO: 590156 - DNA, 512 bp, Homo sapiens
  misc_feature: HIJSMM301EC7J2.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccaccctcctcgctacga

SEQ ID NO: 590157 - DNA, 503 bp, Homo sapiens; identical to SEQ ID NO: 577091
  misc_feature: HIJSMM301BECQI.4.57.F02.1.454.light.4.raw

SEQ ID NO: 590158 - DNA, 524 bp, Homo sapiens
  misc_feature: HIJSMM301B9SA4.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaacccccactcgtcactctgttcccaccctccctccgtcg

SEQ ID NO: 590159 - DNA, 507 bp, Homo sapiens; identical to SEQ ID NO: 571491
  misc_feature: HIJSMM301BQU3Q.43.3.A03.1.454.light.4.raw

SEQ ID NO: 590160 - DNA, 490 bp, Homo sapiens; identical to SEQ ID NO: 540409
  misc_feature: HIJSMM301DCR5C.15.8.A08.1.454.light.4.raw

SEQ ID NO: 590161 - DNA, 489 bp, Homo sapiens; identical to SEQ ID NO: 537328
  misc_feature: HIJSMM301B9G1M.13.5.A05.1.454.light.4.raw

SEQ ID NO: 590162 - DNA, 512 bp, Homo sapiens
  misc_feature: HIJSMM301BLU7B.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatccatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccgaaagtaggatatcaaacgaactagtggctgcaccatctgtcttcta

SEQ ID NO: 590163 - DNA, 501 bp, Homo sapiens; identical to SEQ ID NO: 535746
  misc_feature: HIJSMM301BPEV9.18.11.A11.1.454.light.4.raw

SEQ ID NO: 590164 - DNA, 522 bp, Homo sapiens; identical to SEQ ID NO: 538091
  misc_feature: HIJSMM301BSR8C.27.23.C01.1.454.light.4.raw

SEQ ID NO: 590165 - DNA, 455 bp, Homo sapiens; identical to SEQ ID NO: 550155
  misc_feature: HIJSMM301A5SLH.5.86.H09.1.454.light.4.raw

SEQ ID NO: 590166 - DNA, 494 bp, Homo sapiens
  misc_feature: HIJSMM301CW3SZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagattaaacgaactagtggctgcaccatctgtctt

SEQ ID NO: 590167 - DNA, 520 bp, Homo sapiens; identical to SEQ ID NO: 535686
  misc_feature: HIJSMM301DOEFT.41.19.B08.1.454.light.4.raw

SEQ ID NO: 590168 - DNA, 374 bp, Homo sapiens
  misc_feature: HIJSMM301EM08J.49.68.G02.1.454.light.4.raw
agtcgagagacacgaccggtgctcgatttagtcgatagtgaagggaaagggccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtcttcatcttcccgccatctgatctctcgact

SEQ ID NO: 590169 - DNA, 462 bp, Homo sapiens
  misc_feature: HIJSMM301B7N2K.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgctgggcaagtcagagcataagcgactctttaaattggtatcagaagaaaccaggaaaagcccctaaactcctgatctctgctgccgccagtttgcaaagtgggtcccatcaagattcagtggcagtggatctgggacagatttcactctcgccatcagtagtctgcaacctgatgattttgcaacttactactgtcaacagagttccactaccccaatcactttcgccctggactgaagtgcatatgaagagaa

SEQ ID NO: 590170 - DNA, 495 bp, Homo sapiens
  misc_feature: HIJSMM301BXBCI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtaggaaatacaaacgaaactgtggctgcaccatctgtctt

SEQ ID NO: 590171 - DNA, 483 bp, Homo sapiens
  misc_feature: HIJSMM301BD8R8.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtactacttttggccaggggaccaagctggagatcaggcgaactgtggctgca

SEQ ID NO: 590172 - DNA, 502 bp, Homo sapiens; identical to SEQ ID NO: 545036
  misc_feature: HIJSMM301A7M3R.15.57.F02.1.454.light.4.raw

SEQ ID NO: 590173 - DNA, 513 bp, Homo sapiens; identical to SEQ ID NO: 567801
  misc_feature: HIJSMM301APO7M.16.66.F11.1.454.light.4.raw

SEQ ID NO: 590174 - DNA, 522 bp, Homo sapiens
  misc_feature: HIJSMM301A5NZ8.40.46.E02.1.454.light.4.raw
tctagcgactcacgaccggtgctcgatttagactcatctacagggaaaggggagtctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaacccactgtcactctgttcccgcctcctcagtcgctacg

SEQ ID NO: 590175 - DNA, 504 bp, Homo sapiens; identical to SEQ ID NO: 535128
  misc_feature: HIJSMM301ESXTB.19.85.H08.1.454.light.4.raw

SEQ ID NO: 590176 - DNA, 497 bp, Homo sapiens
  misc_feature: HIJSMM301DAXF8.11.67.G01.1.454.light.4.raw
cgagagataccacgaccggtgctcgatttagagtatacatattgggtttggggcagcttcaactgtgggttgagaagacaggactcgggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagccc

SEQ ID NO: 590177 - DNA, 491 bp, Homo sapiens; identical to SEQ ID NO: 536211
  misc_feature: HIJSMM301CAAWI.16.53.E09.1.454.light.4.raw

SEQ ID NO: 590178 - DNA, 494 bp, Homo sapiens; identical to SEQ ID NO: 535629
  misc_feature: HIJSMM301DDTQ4.4.27.C05.1.454.light.4.raw

SEQ ID NO: 590179 - DNA, 420 bp, Homo sapiens
  misc_feature: HIJSMM301EQAJE.22.21.B10.1.454.light.4.raw
acatacgcgtcacgaccggtgctcgatttagtgtcgtcgcaaggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtcaggctgccccctcggtcactctgttcccgccctcctcacgcgtatgt

SEQ ID NO: 590180 - DNA, 489 bp, Homo sapiens; identical to SEQ ID NO: 536013
  misc_feature: HIJSMM301ATCLA.26.23.C01.1.454.light.4.raw

SEQ ID NO: 590181 - DNA, 487 bp, Homo sapiens; identical to SEQ ID NO: 537220
  misc_feature: HIJSMM301EZ0VQ.16.53.E09.1.454.light.4.raw

SEQ ID NO: 590182 - DNA, 441 bp, Homo sapiens; identical to SEQ ID NO: 551059
  misc_feature: HIJSMM301BLGRD.11.3.A03.1.454.light.4.raw
  modified_base (423)..(423): a, c, t, g, unknown or other

SEQ ID NO: 590183 - DNA, 495 bp, Homo sapiens; identical to SEQ ID NO: 538269
  misc_feature: HIJSMM301A013K.9.1.A01.1.454.light.4.raw

SEQ ID NO: 590184 - DNA, 514 bp, Homo sapiens
  misc_feature: HIJSMM301AD1CG.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtgacctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcaagccaaggctgccccctcggtcactctgttccccg

SEQ ID NO: 590185 - DNA, 488 bp, Homo sapiens; identical to SEQ ID NO: 559331
  misc_feature: HIJSMM301EMS5A.47.36.D03.1.454.light.4.raw

SEQ ID NO: 590186 - DNA, 481 bp, Homo sapiens
  misc_feature: HIJSMM301B4BSW.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgtgggctctatattgcatgcagctctacaagtcccgctcactttcggcggagggaccaaggtggagatcaaacgaa

SEQ ID NO: 590187 - DNA, 487 bp, Homo sapiens; identical to SEQ ID NO: 558047
  misc_feature: HIJSMM301DEBET.4.26.C04.1.454.light.4.raw

SEQ ID NO: 590188 - DNA, 494 bp, Homo sapiens; identical to SEQ ID NO: 543242
  misc_feature: HIJSMM301EZ268.27.78.H01.1.454.light.4.raw
  modified_base (462)..(462): a, c, t, g, unknown or other

SEQ ID NO: 590189 - DNA, 494 bp, Homo sapiens; identical to SEQ ID NO: 534992
  misc_feature: HIJSMM301CL6RV.9.1.A01.1.454.light.4.raw

SEQ ID NO: 590190 - DNA, 486 bp, Homo sapiens
  misc_feature: HIJSMM301EMX4K.10.59.F04.1.454.light.4.raw
catagtagtgcacgaccggtgctcgatttagtacacacacttagggattggggggggtctcaggaggcaacactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcggggtccctgatcgcttctctggctccaagtctggcaacacggcctcctgaccatctctggcctccagcctgaggatgaggctgattattactgttgctcatatgtaggcggtaccgcttgggtgttcggcggagggaccaagctgaccgtcctaggtccagccc

SEQ ID NO: 590191 - DNA, 509 bp, Homo sapiens; identical to SEQ ID NO: 553073
  misc_feature: HIJSMM301ERQVZ.16.1.A01.1.454.light.4.raw

SEQ ID NO: 590192 - DNA, 486 bp, Homo sapiens; identical to SEQ ID NO: 535043
  misc_feature: HIJSMM301BH59M.46.35.D02.1.454.light.4.raw

SEQ ID NO: 590193 - DNA, 488 bp, Homo sapiens; identical to SEQ ID NO: 576429
  misc_feature: HIJSMM301E1U4R.5.6.A06.1.454.light.4.raw

SEQ ID NO: 590194 - DNA, 444 bp, Homo sapiens; identical to SEQ ID NO: 544367
  misc_feature: HIJSMM301ALTZ5.2.76.G10.1.454.light.4.raw

SEQ ID NO: 590195 - DNA, 505 bp, Homo sapiens
  misc_feature: HIJSMM301AHF7T.18.26.C04.1.454.light.4.raw
tacgagtatgcacgaccggtgctcgatttagtctagcgactttggggtttgggggggtcgagacccacgtcgggacacagcatggacatgagggtccccgcctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttggcggagggaccaaggtagagatcaaaggaactgtggctgcaccatctgtcttcatcttcccgccca

SEQ ID NO: 590196 - DNA, 490 bp, Homo sapiens; identical to SEQ ID NO: 541974
  misc_feature: HIJSMM301APKID.22.65.F10.1.454.light.4.raw

SEQ ID NO: 590197 - DNA, 488 bp, Homo sapiens
  misc_feature: HIJSMM301DLAH9.15.28.C06.1.454.light.4.raw
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaagggtggagatcaaacgaactgtggctgcaccatctgtcttcatt

SEQ ID NO: 590198 - DNA, 491 bp, Homo sapiens; identical to SEQ ID NO: 535194
  misc_feature: HIJSMM301DKMIZ.26.78.H01.1.454.light.4.raw

SEQ ID NO: 590199 - DNA, 503 bp, Homo sapiens
  misc_feature: HIJSMM301DJNX3.47.55.E11.1.454.light.4.raw
agctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccaccctcctcta

SEQ ID NO: 590200 - DNA, 487 bp, Homo sapiens; identical to SEQ ID NO: 544897
  misc_feature: HIJSMM301AF19A.46.35.D02.1.454.light.4.raw

SEQ ID NO: 590201 - DNA, 504 bp, Homo sapiens
  misc_feature: HIJSMM301BBI5X.17.33.C11.1.454.light.4.raw
cgtagactagcacgaccggtgctcgatttagagtgagctcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggcctg

SEQ ID NO: 590202 - DNA, 508 bp, Homo sapiens
  misc_feature: HIJSMM301B4QXG.43.60.F05.1.454.light.4.raw
  modified_base (499)..(499): a, c, t, g, unknown or other
tgtgagtagtcacgaccggtgctcgatttagtacgtcatcagggaaagggggagtcagacccactcaggacacagcatggacgggggatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcgcggaccgacggtcggagtgtcgtaagacgaacgtacgtggtcgtgtcgaccactnttccccccg

SEQ ID NO: 590203 - DNA, 448 bp, Homo sapiens
  misc_feature: HIJSMM301CCOUJ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccccgccctcctccatactcgta

SEQ ID NO: 590204 - DNA, 501 bp, Homo sapiens; identical to SEQ ID NO: 555551
  misc_feature: HIJSMM301DOIT0.21.81.H04.1.454.light.4.raw

SEQ ID NO: 590205 - DNA, 510 bp, Homo sapiens
  misc_feature: HIJSMM301B2H8M.15.34.D01.1.454.light.4.raw
  modified_base (448)..(448): a, c, t, g, unknown or other
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggngttcggcggaagggaccaaactgaccgtcctaggtcagcccaaggcctgccccctggtcact

SEQ ID NO: 590206 - DNA, 496 bp, Homo sapiens
  misc_feature: HIJSMM301ANXRA.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttatactgtcagcagtattatactactcctctgacgttcggccaaagggaccaaaggtggagatacaaacgaactgtggctgcaccat

SEQ ID NO: 590207 - DNA, 485 bp, Homo sapiens; identical to SEQ ID NO: 535688
  misc_feature: HIJSMM301A5B82.19.5.A05.1.454.light.4.raw

SEQ ID NO: 590208 - DNA, 496 bp, Homo sapiens; identical to SEQ ID NO: 536802
  misc_feature: HIJSMM301CS6GB.5.24.C02.1.454.light.4.raw

SEQ ID NO: 590209 - DNA, 504 bp, Homo sapiens; identical to SEQ ID NO: 535561
  misc_feature: HIJSMM301C2FV5.4.57.F02.1.454.light.4.raw

SEQ ID NO: 590210 - DNA, 496 bp, Homo sapiens; identical to SEQ ID NO: 535423
  misc_feature: HIJSMM301AQ045.3.33.C11.1.454.light.4.raw

SEQ ID NO: 590211 - DNA, 499 bp, Homo sapiens
  misc_feature: HIJSMM301DJQOR.48.82.H05.1.454.light.4.raw
agtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgtcccctc

SEQ ID NO: 590212 - DNA, 494 bp, Homo sapiens; identical to SEQ ID NO: 543242
  misc_feature: HIJSMM301BYCS4.27.78.H01.1.454.light.4.raw
  modified_base (462)..(462): a, c, t, g, unknown or other

SEQ ID NO: 590213 - DNA, 521 bp, Homo sapiens; identical to SEQ ID NO: 538715
  misc_feature: HIJSMM301EX9O7.27.23.C01.1.454.light.4.raw

SEQ ID NO: 590214 - DNA, 497 bp, Homo sapiens; identical to SEQ ID NO: 536371
  misc_feature: HIJSMM301CI2AG.16.78.H01.1.454.light.4.raw

SEQ ID NO: 590215 - DNA, 491 bp, Homo sapiens
  misc_feature: HIJSMM301CNO2B.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagtattttgcagtctattactgtcagcagtatggtcacgtcccaagtaacttttggccgaggggaccaagctggagatacaaacgaactgtggctgcaccat

SEQ ID NO: 590216 - DNA, 501 bp, Homo sapiens; identical to SEQ ID NO: 535509
  misc_feature: HIJSMM301BSCXK.15.56.F01.1.454.light.4.raw

SEQ ID NO: 590217 - DNA, 499 bp, Homo sapiens
  misc_feature: HIJSMM301CF63P.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaacgggaccgaacggtaggaagtacgaaacgaactagtggctgcaccatctgtctt

SEQ ID NO: 590218 - DNA, 496 bp, Homo sapiens
  misc_feature: HIJSMM301EED3P.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgcttccgtacacttttggccagggggaccaaagttggagatcaaacgaactgtgg

SEQ ID NO: 590219 - DNA, 522 bp, Homo sapiens
  misc_feature: HIJSMM301B4U0Z.27.23.C01.1.454.light.4.raw
agcgtcgtctcacgaccggtgctcgatttagtacacgtgattagggattggggggggtctcagggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 590220 - DNA, 507 bp, Homo sapiens
  misc_feature: HIJSMM301DEK39.49.31.C09.1.454.light.4.raw
agtcgagagacacgaccggtgctcgatttagacgtctcatcaaggaaggaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtatttcggcggagggaccaagctgaccgtcctaggtcagcccaaggctgccccctcggtcactctgttcccg

SEQ ID NO: 590221 - DNA, 523 bp, Homo sapiens
  misc_feature: HIJSMM301EL9M9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctggaccgtcctaggtcagcccaaggctgccccctcggtcactctgttcccgccct

SEQ ID NO: 590222 - DNA, 512 bp, Homo sapiens; identical to SEQ ID NO: 545961
  misc_feature: HIJSMM301CSC75.14.78.H01.1.454.light.4.raw

SEQ ID NO: 590223 - DNA, 502 bp, Homo sapiens; identical to SEQ ID NO: 558110
  misc_feature: HIJSMM301DTFJK.4.6.A06.1.454.light.4.raw

SEQ ID NO: 590224 - DNA, 508 bp, Homo sapiens; identical to SEQ ID NO: 537871
  misc_feature: HIJSMM301DENC2.8.33.C11.1.454.light.4.raw

SEQ ID NO: 590225 - DNA, 506 bp, Homo sapiens
  misc_feature: HIJSMM301DNGFL.5.24.C02.1.454.light.4.raw
  modified_base (449)..(449): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatntgatcttcggcgggggaccaagctgaccgtcctaggtcagcccaaggctgccccccg

SEQ ID NO: 590226 - DNA, 507 bp, Homo sapiens
  misc_feature: HIJSMM301BD3BG.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgttcccccg

SEQ ID NO: 590227 - DNA, 491 bp, Homo sapiens; identical to SEQ ID NO: 535294
  misc_feature: HIJSMM301C1OWA.16.68.G02.1.454.light.4.raw

SEQ ID NO: 590228 - DNA, 506 bp, Homo sapiens
  misc_feature: HIJSMM301B4Y02.10.70.G04.1.454.light.4.raw
catagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctccctggccatcactgggctccaggctgaggatgaggctgattattactgccagtcccatgacaacagcctgagtgtttgggtgttcggcggagggaccaagctgaccgtcttagtcagcccaaggctgccccctcggtcactctgttcccaccctcctccta

SEQ ID NO: 590229 - DNA, 454 bp, Homo sapiens; identical to SEQ ID NO: 535005
  misc_feature: HIJSMM301CEN2D.19.86.H09.1.454.light.4.raw

SEQ ID NO: 590230 - DNA, 499 bp, Homo sapiens; identical to SEQ ID NO: 575204
  misc_feature: HIJSMM301DVAC9.5.24.C02.1.454.light.4.raw

SEQ ID NO: 590231 - DNA, 507 bp, Homo sapiens; identical to SEQ ID NO: 535316
  misc_feature: HIJSMM301BJXEX.18.37.D04.1.454.light.4.raw

SEQ ID NO: 590232 - DNA, 505 bp, Homo sapiens; identical to SEQ ID NO: 535503
  misc_feature: HIJSMM301CIF0C.8.28.C06.1.454.light.4.raw

SEQ ID NO: 590233 - DNA, 389 bp, Homo sapiens; identical to SEQ ID NO: 540091
  misc_feature: HIJSMM301DYO9J.21.40.D07.1.454.light.4.raw

SEQ ID NO: 590234 - DNA, 502 bp, Homo sapiens
  misc_feature: HIJSMM301B9MLE.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactggggaccacggtcaccgtcctaggt

SEQ ID NO: 590235 - DNA, 527 bp, Homo sapiens
  misc_feature: HIJSMM301EPNXI.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccgaaaacgtaggaaatacaaacgaaaaccgtagtggctcgcacccaatctgttcttctactcttcccgcccact

SEQ ID NO: 590236 - DNA, 491 bp, Homo sapiens
  misc_feature: HIJSMM301BDTUV.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcgcaagggacacgactggagattaaacgaactgtggctgcaccatctgtctt

SEQ ID NO: 590237 - DNA, 490 bp, Homo sapiens; identical to SEQ ID NO: 541567
  misc_feature: HIJSMM301AVIWN.22.65.F10.1.454.light.4.raw

SEQ ID NO: 590238 - DNA, 470 bp, Homo sapiens
  misc_feature: HIJSMM301B154A.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgcacttttggcgggggtaccaaggtggacatcaaacgaa

SEQ ID NO: 590239 - DNA, 504 bp, Homo sapiens; identical to SEQ ID NO: 535128
  misc_feature: HIJSMM301A3LJZ.19.85.H08.1.454.light.4.raw

SEQ ID NO: 590240 - DNA, 506 bp, Homo sapiens
  misc_feature: HIJSMM301CF94G.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgcttacttcgtcggagggacgaacgtaggacgatactaaacgaaactacgtggcgtcgcgaccaactctcgttcg

SEQ ID NO: 590241 - DNA, 504 bp, Homo sapiens
  misc_feature: HIJSMM301AC8UP.26.26.C04.1.454.light.4.raw
agactatactcacgaccggtgctcgatttagtctagcgactttgggtttgggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactgggccgtggacgttcggccaagggaccgaacggtggaaatacaaacgaactagtggctgcacc

SEQ ID NO: 590242 - DNA, 487 bp, Homo sapiens; identical to SEQ ID NO: 554782
  misc_feature: HIJSMM301C74A1.46.35.D02.1.454.light.4.raw

SEQ ID NO: 590243 - DNA, 490 bp, Homo sapiens; identical to SEQ ID NO: 544556
  misc_feature: HIJSMM301CP64Q.15.3.A03.1.454.light.4.raw

SEQ ID NO: 590244 - DNA, 496 bp, Homo sapiens
  misc_feature: HIJSMM301A6AGG.48.26.C04.1.454.light.4.raw
agtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggct

SEQ ID NO: 590245 - DNA, 503 bp, Homo sapiens
  misc_feature: HIJSMM301B88VR.48.83.H06.1.454.light.4.raw
agtatacatacacgaccggtgctcgatttagatcacgtgcgtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctcgtcccgccctcct

SEQ ID NO: 590246 - DNA, 513 bp, Homo sapiens; identical to SEQ ID NO: 543313
  misc_feature: HIJSMM301D3QGU.22.36.D03.1.454.light.4.raw

SEQ ID NO: 590247 - DNA, 483 bp, Homo sapiens; identical to SEQ ID NO: 540738
  misc_feature: HIJSMM301D7DXI.48.85.H08.1.454.light.4.raw

SEQ ID NO: 590248 - DNA, 516 bp, Homo sapiens; identical to SEQ ID NO: 580926
  misc_feature: HIJSMM301BC92I.8.43.D10.1.454.light.4.raw

SEQ ID NO: 590249 - DNA, 507 bp, Homo sapiens
  misc_feature: HIJSMM301CW5QJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtcaaacgaactagtggctgcaccactctgtcttctatcttccccg

SEQ ID NO: 590250 - DNA, 487 bp, Homo sapiens
  misc_feature: HIJSMM301C6FD6.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaatcaaacgaactgtggctgcaccat

SEQ ID NO: 590251 - DNA, 482 bp, Homo sapiens
  misc_feature: HIJSMM301A4FG6.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaacgggaccaaggtggaaagtcaaacgaactgtggctgcacca

SEQ ID NO: 590252 - DNA, 486 bp, Homo sapiens
  misc_feature: HIJSMM301D85CO.41.37.D04.1.454.light.4.raw
tctatactatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagacaccctgtctgtgtctccaggggaaagagccaccctctcctgcagggccagtcagagtgtcaccaacaagttggcctggtaccagcagaaatctggtcagtctcccaggctcctcatttacagtgcagacaccagggccactggtgtcccagacaggttcagtggcagtgggtctgggacagagttcactctcagcctcagcagccttcagtctgaagattttgcagtgtattactgtcagcaatatcataagtggcctctcactttcggcggagggaccaaggtggagatcaaacgaactgtggctgcaccat

SEQ ID NO: 590253 - DNA, 510 bp, Homo sapiens
  misc_feature: HIJSMM301D0KYH.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactgtggctgcaccatctgtcttcatt

SEQ ID NO: 590254 - DNA, 508 bp, Homo sapiens
  misc_feature: HIJSMM301CJ2EW.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatggggatgacaatctgaggcggttgggtgttcgggcggagggaccaaactgaccgtcctaggtccaggcccaa

SEQ ID NO: 590255 - DNA, 489 bp, Homo sapiens
  misc_feature: HIJSMM301C4Z9O.5.42.D09.1.454.light.4.raw
atcagacacgcacgaccggtgctcgatttagacacatacgcagggaaaggggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataattagttaattggacgttcggccaggggacgaaggtcgaaatgagacgaactgtggctgcaccaatctgtt

SEQ ID NO: 590256 - DNA, 493 bp, Homo sapiens; identical to SEQ ID NO: 542962
  misc_feature: HIJSMM301A5RKM.14.53.E09.1.454.light.4.raw

SEQ ID NO: 590257 - DNA, 514 bp, Homo sapiens; identical to SEQ ID NO: 544770
  misc_feature: HIJSMM301DYZ57.16.66.F11.1.454.light.4.raw

SEQ ID NO: 590258 - DNA, 499 bp, Homo sapiens; identical to SEQ ID NO: 547044
  misc_feature: HIJSMM301BIG4V.43.71.G05.1.454.light.4.raw

SEQ ID NO: 590259 - DNA, 509 bp, Homo sapiens; identical to SEQ ID NO: 537131
  misc_feature: HIJSMM301A92JL.17.33.C11.1.454.light.4.raw

SEQ ID NO: 590260 - DNA, 489 bp, Homo sapiens
  misc_feature: HIJSMM301CFGZY.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatacaaacgaactagtggctgcaccat

SEQ ID NO: 590261 - DNA, 507 bp, Homo sapiens; identical to SEQ ID NO: 584670
  misc_feature: HIJSMM301ER4CW.19.78.H01.1.454.light.4.raw

SEQ ID NO: 590262 - DNA, 478 bp, Homo sapiens
  misc_feature: HIJSMM301BDE9U.26.72.G06.1.454.light.4.raw
  modified_base (348)..(348): a, c, t, g, unknown or other
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagngatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 590263 - DNA, 512 bp, Homo sapiens
  misc_feature: HIJSMM301CJH81.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccgt

SEQ ID NO: 590264 - DNA, 486 bp, Homo sapiens; identical to SEQ ID NO: 535523
  misc_feature: HIJSMM301AYOLN.22.73.G07.1.454.light.4.raw

SEQ ID NO: 590265 - DNA, 495 bp, Homo sapiens; identical to SEQ ID NO: 536055
  misc_feature: HIJSMM301BU57P.47.38.D05.1.454.light.4.raw

SEQ ID NO: 590266 - DNA, 516 bp, Homo sapiens
  misc_feature: HIJSMM301CL0N9.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattaatgtgataattgcggagggaccagggtgacgtcctaggtcagcccaaggctgccccctcggtcactctgttccc

SEQ ID NO: 590267 - DNA, 515 bp, Homo sapiens
  misc_feature: HIJSMM301D1BBE.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggacgaacggtaggaagtacgaaacgaactacgtggcgtgcaccactctgtcttctactcttcccgtcccact

SEQ ID NO: 590268 - DNA, 522 bp, Homo sapiens
  misc_feature: HIJSMM301ANQ76.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtgacacttgggtgttcggcggagggaccaggctgaccgtcctaggtcagcccaaggctgccccctcggtcactctgttcccgccct

SEQ ID NO: 590269 - DNA, 503 bp, Homo sapiens
  misc_feature: HIJSMM301CQ02J.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctcgccccctcggtcta

SEQ ID NO: 590270 - DNA, 489 bp, Homo sapiens
  misc_feature: HIJSMM301D21GG.19.71.G05.1.454.light.4.raw
  modified_base (236)..(236): a, c, t, g, unknown or other
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatctttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaa

SEQ ID NO: 590271 - DNA, 493 bp, Homo sapiens
  misc_feature: HIJSMM301DC9AS.27.78.H01.1.454.light.4.raw
  modified_base (397)..(397): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttnttactgtcatcagagtactacttacctcaagtgatcaccttcggccaagggacacgactggagaattaaacgaactgtggctgcaccatctgtctt

SEQ ID NO: 590272 - DNA, 510 bp, Homo sapiens
  misc_feature: HIJSMM301A4FJ7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctaccggcaatccggggtccctgaccgattcagtggcagcgggtctgggacagatttcactctcaccatcagcagcctgcaggctgaagatgtggcagtttattactgtcaactagttttctcggggcttcggccgtaagggaccaaggtcgggaaatcgaaaacgaactagtggctgcaccatctgtcttcactcttccccg

SEQ ID NO: 590273 - DNA, 509 bp, Homo sapiens; identical to SEQ ID NO: 553073
  misc_feature: HIJSMM301DUDRN.16.1.A01.1.454.light.4.raw

SEQ ID NO: 590274 - DNA, 497 bp, Homo sapiens; identical to SEQ ID NO: 544443
  misc_feature: HIJSMM301BVML5.51.39.D06.1.454.light.4.raw

SEQ ID NO: 590275 - DNA, 503 bp, Homo sapiens
  misc_feature: HIJSMM301BU3LR.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactcc

SEQ ID NO: 590276 - DNA, 487 bp, Homo sapiens
  misc_feature: HIJSMM301CLM8T.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcaccttcggccaagggacacgactggagatgaaacgaactgtggctgcacca

SEQ ID NO: 590277 - DNA, 497 bp, Homo sapiens; identical to SEQ ID NO: 535664
  misc_feature: HIJSMM301BI323.22.14.B03.1.454.light.4.raw

SEQ ID NO: 590278 - DNA, 475 bp, Homo sapiens; identical to SEQ ID NO: 562103
  misc_feature: HIJSMM301CXOD2.13.76.G10.1.454.light.4.raw

SEQ ID NO: 590279 - DNA, 496 bp, Homo sapiens
  misc_feature: HIJSMM301AENOR.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccggttcacttttggtccaggggaccgaaacctaggatatcagacgaactagtggctgca

SEQ ID NO: 590280 - DNA, 494 bp, Homo sapiens
  misc_feature: HIJSMM301CL6PZ.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccttcagtggagtccaggcagaggacgaggctgactaccactgtcaatcaacagacagcagtggttcttatgtcttcgcaactgggaccaaggtcaccgtctaggtcagcccaaggccaacccactgtcactctcg

SEQ ID NO: 590281 - DNA, 494 bp, Homo sapiens; identical to SEQ ID NO: 534994
  misc_feature: HIJSMM301CGE03.27.78.H01.1.454.light.4.raw

SEQ ID NO: 590282 - DNA, 491 bp, Homo sapiens
  misc_feature: HIJSMM301ARF4X.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaacgtcaccgtcctaggtcagcccaaggccaaccccactgtcta

SEQ ID NO: 590283 - DNA, 504 bp, Homo sapiens; identical to SEQ ID NO: 554247
  misc_feature: HIJSMM301CHH2C.19.78.H01.1.454.light.4.raw

SEQ ID NO: 590284 - DNA, 482 bp, Homo sapiens
  misc_feature: HIJSMM301CGDIV.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaaattcactctcaccatcagcagcctgcaacctgatgactttgcaacttattactgccaacagtataatgtatgaatccactttgcaaggacaagctggagatcaaacgaactgtgctgcacca

SEQ ID NO: 590285 - DNA, 484 bp, Homo sapiens; identical to SEQ ID NO: 535400
  misc_feature: HIJSMM301AXBDR.46.26.C04.1.454.light.4.raw

SEQ ID NO: 590286 - DNA, 479 bp, Homo sapiens; identical to SEQ ID NO: 537235
  misc_feature: HIJSMM301DVAUI.22.59.F04.1.454.light.4.raw

SEQ ID NO: 590287 - DNA, 516 bp, Homo sapiens
  misc_feature: HIJSMM301BBVDF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacagggccactggcatcccagacaggttcagtggccgtgggtctgggacagagttcagtctcaccatcagcagactggagcctgaagattttgcagtatattactgtcagcaatatggtacttcaccccggacgtcgtccgacgggaccgaacggtaggaaggtacaaacgaactacgtggcgtgcaccactctgtcttctatcttcccgtcccact

SEQ ID NO: 590288 - DNA, 486 bp, Homo sapiens; identical to SEQ ID NO: 557950
  misc_feature: HIJSMM301BEDR0.15.1.A01.1.454.light.4.raw

SEQ ID NO: 590289 - DNA, 476 bp, Homo sapiens
  misc_feature: HIJSMM301C4D2U.40.59.F04.1.454.light.4.raw
  modified_base (444)..(444): a, c, t, g, unknown or other
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggacacagccactctgaccatcagcgggacccaggctatggatgaggctgactattactgtcaggcgtgggacatcagcagtgaggtggtttggtcggngggacgaacgacgtagcgtaccgtacgtacta

SEQ ID NO: 590290 - DNA, 490 bp, Homo sapiens; identical to SEQ ID NO: 541567
  misc_feature: HIJSMM301D81J1.22.65.F10.1.454.light.4.raw

SEQ ID NO: 590291 - DNA, 485 bp, Homo sapiens
  misc_feature: HIJSMM301A20X6.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtaccccccccacgttcggcggagggaccacagtcgagatcaaacgaactgtggctgcaccat

SEQ ID NO: 590292 - DNA, 495 bp, Homo sapiens
  misc_feature: HIJSMM301DPXTU.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaatacaacgaactgtggctgcaccatctgtctt

SEQ ID NO: 590293 - DNA, 475 bp, Homo sapiens
  misc_feature: HIJSMM301CXH66.48.57.F02.1.454.light.4.raw
agtatacatacacgaccggtgctcgatttagctcgatatagttgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 590294 - DNA, 504 bp, Homo sapiens
  misc_feature: HIJSMM301DD2XV.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctggactattactgtgcatcacgggacgcaacatgggatggacaatctgagcggttgggtgttcggcggagggaccaaactgaccgtcctaggtcagcccaa

SEQ ID NO: 590295 - DNA, 490 bp, Homo sapiens
  misc_feature: HIJSMM301DJOGO.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccctcactttcggcggagggaccaaggcggaggatcagacgaactgtggctgcaccatctgtcttcta

SEQ ID NO: 590296 - DNA, 528 bp, Homo sapiens
  misc_feature: HIJSMM301C5K7C.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaaagctgccctgacccgtaacgggggcgcagcctgaggacgaggccgactattattgcctactatcatttgatggtggtcgtctgcccattttcggcggcgggaccagggtggccgtcctgggtcagcccaaggctcgcccctcggtcactctcgttcccgccctcctcctagtctacg

SEQ ID NO: 590297 - DNA, 512 bp, Homo sapiens
  misc_feature: HIJSMM301BH08W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtactaaacgaacctagtggcgtgcaccactctgtcttctatcttccccg

SEQ ID NO: 590298 - DNA, 492 bp, Homo sapiens
  misc_feature: HIJSMM301DVJC3.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcgggggtttactacttgcatgcagggtacactctggccgttcacttttggccaggggaccaaactggatatcagacgaactgtggctgca

SEQ ID NO: 590299 - DNA, 502 bp, Homo sapiens; identical to SEQ ID NO: 536253
  misc_feature: HIJSMM301D9T5W.21.22.B11.1.454.light.4.raw

SEQ ID NO: 590300 - DNA, 516 bp, Homo sapiens
  misc_feature: HIJSMM301BMV4H.51.25.C03.1.454.light.4.raw
cgatcgtatacacgaccggtgctcgatttagtagtgtagatttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttcatcttccccg

SEQ ID NO: 590301 - DNA, 415 bp, Homo sapiens
  misc_feature: HIJSMM301DXSB7.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgcctcctccatactcgta

SEQ ID NO: 590302 - DNA, 509 bp, Homo sapiens
  misc_feature: HIJSMM301BG92N.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattatactgtgcaacatgggatgacagcctgaatggtccggtattcggcggagggaccaaaggctgaccgtcctcggtcagcccaaggctgccccctc

SEQ ID NO: 590303 - DNA, 495 bp, Homo sapiens
  misc_feature: HIJSMM301BCWAZ.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctggctccaggctgaagacgaggctgattattactgcagctcatatacaggcagcagcactcaggttttcggcggagggaccaagctgaccgtcctaggtcagcccaagctgccccctcggt

SEQ ID NO: 590304 - DNA, 515 bp, Homo sapiens
  misc_feature: HIJSMM301AFRVG.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggtttttcggcggagggaccaagctgaccgtcctaggtcagcccaaggctgccccctcggtcactctgttccccg

SEQ ID NO: 590305 - DNA, 495 bp, Homo sapiens; identical to SEQ ID NO: 537415
  misc_feature: HIJSMM301C8Q1V.4.27.C05.1.454.light.4.raw

SEQ ID NO: 590306 - DNA, 481 bp, Homo sapiens; identical to SEQ ID NO: 537385
  misc_feature: HIJSMM301CUQND.52.4.A04.1.454.light.4.raw

SEQ ID NO: 590307 - DNA, 506 bp, Homo sapiens; identical to SEQ ID NO: 545735
  misc_feature: HIJSMM301AMVKS.8.71.G05.1.454.light.4.raw

SEQ ID NO: 590308 - DNA, 487 bp, Homo sapiens; identical to SEQ ID NO: 541729
  misc_feature: HIJSMM301CCZ9W.40.83.H06.1.454.light.4.raw

SEQ ID NO: 590309 - DNA, 487 bp, Homo sapiens
  misc_feature: HIJSMM301EU1N0.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccatctgtcttt

SEQ ID NO: 590310 - DNA, 444 bp, Homo sapiens; identical to SEQ ID NO: 535594
  misc_feature: HIJSMM301BPBU0.9.9.A09.1.454.light.4.raw

SEQ ID NO: 590311 - DNA, 503 bp, Homo sapiens
  misc_feature: HIJSMM301ES82F.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtctaggtcagcccaaggctgcccctcggtcactctgtt

SEQ ID NO: 590312 - DNA, 503 bp, Homo sapiens; identical to SEQ ID NO: 535044
  misc_feature: HIJSMM301C16FV.19.78.H01.1.454.light.4.raw

SEQ ID NO: 590313 - DNA, 516 bp, Homo sapiens
  misc_feature: HIJSMM301EM9JC.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctcgttcccaccctcct

SEQ ID NO: 590314 - DNA, 501 bp, Homo sapiens; identical to SEQ ID NO: 535746
  misc_feature: HIJSMM301ENN9Z.18.11.A11.1.454.light.4.raw

SEQ ID NO: 590315 - DNA, 478 bp, Homo sapiens; identical to SEQ ID NO: 535129
  misc_feature: HIJSMM301A91UG.11.11.A11.1.454.light.4.raw

SEQ ID NO: 590316 - DNA, 512 bp, Homo sapiens
  misc_feature: HIJSMM301A2K8E.48.52.E08.1.454.light.4.raw
  modified_base (505)..(505): a, c, t, g, unknown or other
agtatacatacacgaccggtgctcgatttagtcgagctctcagagagaaaggggctgggcctcaggaagcagcatcgggggtgccgcagccatggcctggaccgctctccttctgagcctccttgctcactttacagattctgtggcctcctatgaattgactcagcccttctcagtgtcggtggccctggggcagacggccaggatgacctgtgggggaaacaaaattggaagtaaagatgtgcactggtatcagcacaagccaggccaggcccctctactggtcatttatagggataccaatcggccctctgggatccctgagcggatctctggctccaactcggggaacacggccaccctgaccatcagcggggcccaagccggggatgaggctgactatttctgtcaggtgtgggacagcagcagtgtgattttcggcggcgggaccaagctgaccgtcctaggtcagcccaaggctgccccctcggtcactctgttcccnccctcct

SEQ ID NO: 590317 - DNA, 497 bp, Homo sapiens
  misc_feature: HIJSMM301A4AP1.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcaggtctccgggcacccgtgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagaattaaaggaactgtggctgcaccatctgtcttcatcttccccg

SEQ ID NO: 590318 - DNA, 493 bp, Homo sapiens
  misc_feature: HIJSMM301EIN1G.48.78.H01.1.454.light.4.raw
agtatacatacacgaccggtgctcgatttagtgtgagtagtttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcaggggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 590319 - DNA, 494 bp, Homo sapiens
  misc_feature: HIJSMM301AV41C.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaacgtgtggctgcaccactctgtt

SEQ ID NO: 590320 - DNA, 473 bp, Homo sapiens
  misc_feature: HIJSMM301DB7LO.11.17.B06.1.454.light.4.raw
  modified_base (456)..(456): a, c, t, g, unknown or other
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtgacgttcggccaggaccaacggtggaatnaacgaactagtggctgc

SEQ ID NO: 590321 - DNA, 502 bp, Homo sapiens
  misc_feature: HIJSMM301DAFOL.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctagtcagcccaaggctgccccctggtccactctgttcccaccctccctcgctacgtaga

SEQ ID NO: 590322 - DNA, 496 bp, Homo sapiens
  misc_feature: HIJSMM301CKMEN.41.35.D02.1.454.light.4.raw
tctatactatcacgaccggtgctcgatttagcacacgatagttgggtttggggggggtcgacaagaggcagcgctctcgggacgtctccaccatggcctgggctctgctgctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 590323 - DNA, 502 bp, Homo sapiens; identical to SEQ ID NO: 554531
  misc_feature: HIJSMM301BLDMS.21.81.H04.1.454.light.4.raw

SEQ ID NO: 590324 - DNA, 501 bp, Homo sapiens; identical to SEQ ID NO: 560931
  misc_feature: HIJSMM301D2BF3.43.34.D01.1.454.light.4.raw

SEQ ID NO: 590325 - DNA, 495 bp, Homo sapiens; identical to SEQ ID NO: 536827
  misc_feature: HIJSMM301AJ2XI.48.63.F08.1.454.light.4.raw

SEQ ID NO: 590326 - DNA, 486 bp, Homo sapiens; identical to SEQ ID NO: 535043
  misc_feature: HIJSMM301BNIOS.46.35.D02.1.454.light.4.raw

SEQ ID NO: 590327 - DNA, 478 bp, Homo sapiens
  misc_feature: HIJSMM301B72QS.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgctaacttattactgaccaacagtaataatagttattctctcactttcggcggagggaccaaggtggagatacaaacgaactgt

SEQ ID NO: 590328 - DNA, 482 bp, Homo sapiens
  misc_feature: HIJSMM301DKK6G.52.4.A04.1.454.light.4.raw
cgcagtacgacacgaccggtgctcgatttagagtagtgatcagggggggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcgtaggtcagcccaaggctcgccccctggt

SEQ ID NO: 590329 - DNA, 500 bp, Homo sapiens
  misc_feature: HIJSMM301CTAAM.49.82.H05.1.454.light.4.raw
agtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacacccaggcaaagccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcgggcggagggaccaaggtgaccgtcctaggtcagcccaaggctgcccctcggt

SEQ ID NO: 590330 - DNA, 484 bp, Homo sapiens
  misc_feature: HIJSMM301D1AVS.41.5.A05.1.454.light.4.raw
tctatactatcacgaccggtgctcgatttagatagatagacagggcacgaccggtgctcgatttagatagatagacaggggggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgtac

SEQ ID NO: 590331 - DNA, 485 bp, Homo sapiens; identical to SEQ ID NO: 539691
  misc_feature: HIJSMM301DIOEJ.15.1.A01.1.454.light.4.raw
  modified_base (467)..(467): a, c, t, g, unknown or other

SEQ ID NO: 590332 - DNA, 487 bp, Homo sapiens; identical to SEQ ID NO: 535583
  misc_feature: HIJSMM301DHJBJ.22.73.G07.1.454.light.4.raw

SEQ ID NO: 590333 - DNA, 489 bp, Homo sapiens; identical to SEQ ID NO: 560406
  misc_feature: HIJSMM301CVQVF.12.51.E07.1.454.light.4.raw

SEQ ID NO: 590334 - DNA, 484 bp, Homo sapiens; identical to SEQ ID NO: 536162
  misc_feature: HIJSMM301EILIH.13.59.F04.1.454.light.4.raw

SEQ ID NO: 590335 - DNA, 508 bp, Homo sapiens
  misc_feature: HIJSMM301A13L6.48.61.F06.1.454.light.4.raw
agtatacatacacgaccggtgctcgatttagctacgctctaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacgtggaaatcaaacgaactagtggctgcaccatctgtt

SEQ ID NO: 590336 - DNA, 501 bp, Homo sapiens; identical to SEQ ID NO: 569636
  misc_feature: HIJSMM301C2GS4.21.22.B11.1.454.light.4.raw

SEQ ID NO: 590337 - DNA, 508 bp, Homo sapiens
  misc_feature: HIJSMM301BEI5E.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctctaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgccccctcggt

SEQ ID NO: 590338 - DNA, 495 bp, Homo sapiens
  misc_feature: HIJSMM301EYUPX.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggtaccgaaggtggagttcaaacgaactgtggctgcacatctgtcttcatt

SEQ ID NO: 590339 - DNA, 447 bp, Homo sapiens; identical to SEQ ID NO: 535020
  misc_feature: HIJSMM301DBJTN.18.9.A09.1.454.light.4.raw

SEQ ID NO: 590340 - DNA, 514 bp, Homo sapiens
  misc_feature: HIJSMM301BLBH6.51.37.D04.1.454.light.4.raw
cgatcgtatacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcgggagggaccaagctgaccgtcctaggtcagcccaaggctgccccctcggtccactctcg

SEQ ID NO: 590341 - DNA, 504 bp, Homo sapiens
  misc_feature: HIJSMM301A4ZUM.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctcgcccccc

SEQ ID NO: 590342 - DNA, 473 bp, Homo sapiens; identical to SEQ ID NO: 536937
  misc_feature: HIJSMM301DTIDS.13.76.G10.1.454.light.4.raw

SEQ ID NO: 590343 - DNA, 507 bp, Homo sapiens; identical to SEQ ID NO: 545328
  misc_feature: HIJSMM301CULBL.8.33.C11.1.454.light.4.raw

SEQ ID NO: 590344 - DNA, 461 bp, Homo sapiens
  misc_feature: HIJSMM301EV3TW.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctcgttcccaccctcctcacgcgtatgt

SEQ ID NO: 590345 - DNA, 485 bp, Homo sapiens; identical to SEQ ID NO: 539576
  misc_feature: HIJSMM301BOY4M.4.57.F02.1.454.light.4.raw

SEQ ID NO: 590346 - DNA, 480 bp, Homo sapiens; identical to SEQ ID NO: 535291
  misc_feature: HIJSMM301BHPOV.22.59.F04.1.454.light.4.raw

SEQ ID NO: 590347 - DNA, 480 bp, Homo sapiens; identical to SEQ ID NO: 559070
  misc_feature: HIJSMM301D07DO.21.25.C03.1.454.light.4.raw

SEQ ID NO: 590348 - DNA, 504 bp, Homo sapiens
  misc_feature: HIJSMM301DZRN1.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcgggcggagggaccaggctgaccgtcctgagtcagcccaaggctgcccccc

SEQ ID NO: 590349 - DNA, 497 bp, Homo sapiens; identical to SEQ ID NO: 538296
  misc_feature: HIJSMM301C3NLS.18.11.A11.1.454.light.4.raw

SEQ ID NO: 590350 - DNA, 521 bp, Homo sapiens; identical to SEQ ID NO: 557222
  misc_feature: HIJSMM301EOUHD.41.19.B08.1.454.light.4.raw

SEQ ID NO: 590351 - DNA, 488 bp, Homo sapiens; identical to SEQ ID NO: 535990
  misc_feature: HIJSMM301C2SJX.11.28.C06.1.454.light.4.raw

SEQ ID NO: 590352 - DNA, 502 bp, Homo sapiens; identical to SEQ ID NO: 542090
  misc_feature: HIJSMM301BDIFS.2.76.G10.1.454.light.4.raw

SEQ ID NO: 590353 - DNA, 501 bp, Homo sapiens; identical to SEQ ID NO: 536867
  misc_feature: HIJSMM301A7I0Y.5.86.H09.1.454.light.4.raw

SEQ ID NO: 590354 - DNA, 492 bp, Homo sapiens
  misc_feature: HIJSMM301D23JS.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactcgtggggtcccagacagattcagcggcagtgggtcaggcgctgatttcacactgagaatcagcagggtggaggctgaagatggtcggggtttattactgcatgcagggtacagtgtggccttcgctcgcattcggcggagggaccgaagggtggagatcaaacgaa

SEQ ID NO: 590355 - DNA, 490 bp, Homo sapiens; identical to SEQ ID NO: 543909
  misc_feature: HIJSMM301CTMM1.14.55.E11.1.454.light.4.raw

SEQ ID NO: 590356 - DNA, 514 bp, Homo sapiens; identical to SEQ ID NO: 546238
  misc_feature: HIJSMM301D772C.47.85.H08.1.454.light.4.raw

SEQ ID NO: 590357 - DNA, 503 bp, Homo sapiens; identical to SEQ ID NO: 537216
  misc_feature: HIJSMM301DYI1Z.3.70.G04.1.454.light.4.raw

SEQ ID NO: 590358 - DNA, 471 bp, Homo sapiens; identical to SEQ ID NO: 589670
  misc_feature: HIJSMM301D5DP7.48.51.E07.1.454.light.4.raw

SEQ ID NO: 590359 - DNA, 489 bp, Homo sapiens
  misc_feature: HIJSMM301ENBE5.51.81.H04.1.454.light.4.raw
cgatcgtatacacgaccggtgctcgatttagtagtgtagattcgcggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcacg

SEQ ID NO: 590360 - DNA, 506 bp, Homo sapiens; identical to SEQ ID NO: 579370
  misc_feature: HIJSMM301DF3Y8.5.24.C02.1.454.light.4.raw

SEQ ID NO: 590361 - DNA, 484 bp, Homo sapiens; identical to SEQ ID NO: 535400
  misc_feature: HIJSMM301CNISR.46.26.C04.1.454.light.4.raw

SEQ ID NO: 590362 - DNA, 489 bp, Homo sapiens; identical to SEQ ID NO: 535139
  misc_feature: HIJSMM301BKO7V.14.55.E11.1.454.light.4.raw

SEQ ID NO: 590363 - DNA, 507 bp, Homo sapiens
  misc_feature: HIJSMM301BRVS1.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcacgtttcggcggagggaccaaggtcggacctcaaacgaactgtggctgcaccatctgtcttcatccttcccgc

SEQ ID NO: 590364 - DNA, 470 bp, Homo sapiens
  misc_feature: HIJSMM301CUMEF.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcatacatgggacaacgatattggatggctgttcggcggagggaccaaactgaccgtcctaggtcagccc

SEQ ID NO: 590365 - DNA, 491 bp, Homo sapiens; identical to SEQ ID NO: 535294
  misc_feature: HIJSMM301B9PYD.16.68.G02.1.454.light.4.raw

SEQ ID NO: 590366 - DNA, 495 bp, Homo sapiens
  misc_feature: HIJSMM301B2ME4.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaccatctggttttcggcggggggaccaagttgaccgtcgtgggtcagcccaaggctgccccctcggtcact

SEQ ID NO: 590367 - DNA, 489 bp, Homo sapiens; identical to SEQ ID NO: 554439
  misc_feature: HIJSMM301CPC3H.14.55.E11.1.454.light.4.raw
  modified_base (427)..(427): a, c, t, g, unknown or other

SEQ ID NO: 590368 - DNA, 469 bp, Homo sapiens; identical to SEQ ID NO: 574009
  misc_feature: HIJSMM301AZ0I8.49.75.G09.1.454.light.4.raw

SEQ ID NO: 590369 - DNA, 522 bp, Homo sapiens
  misc_feature: HIJSMM301BEI5V.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccaccct

SEQ ID NO: 590370 - DNA, 487 bp, Homo sapiens; identical to SEQ ID NO: 536206
  misc_feature: HIJSMM301DVF3V.47.38.D05.1.454.light.4.raw

SEQ ID NO: 590371 - DNA, 444 bp, Homo sapiens
  misc_feature: HIJSMM301EDCNA.9.9.A09.1.454.light.4.raw
  modified_base (436)..(436): a, c, t, g, unknown or other
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcanacgtatca

SEQ ID NO: 590372 - DNA, 481 bp, Homo sapiens; identical to SEQ ID NO: 536255
  misc_feature: HIJSMM301EZPLC.10.53.E09.1.454.light.4.raw

SEQ ID NO: 590373 - DNA, 517 bp, Homo sapiens
  misc_feature: HIJSMM301DFN2P.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaacccactgtcactctgttcccaccctcctcgacacg

SEQ ID NO: 590374 - DNA, 510 bp, Homo sapiens
  misc_feature: HIJSMM301ASBR1.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcacgcccaaggctcgccccctcggtccacttcc

SEQ ID NO: 590375 - DNA, 489 bp, Homo sapiens; identical to SEQ ID NO: 557621
  misc_feature: HIJSMM301DEKM5.13.87.H10.1.454.light.4.raw

SEQ ID NO: 590376 - DNA, 491 bp, Homo sapiens; identical to SEQ ID NO: 535194
  misc_feature: HIJSMM301COIP8.26.78.H01.1.454.light.4.raw

SEQ ID NO: 590377 - DNA, 500 bp, Homo sapiens
  misc_feature: HIJSMM301B9VW0.52.35.D02.1.454.light.4.raw
cgcagtacgacacgaccggtgctcgatttagcacacgatagttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggaggaccaaggttgagatcaaacgaactgtggctgcaccatctgtcttcatcttccccg

SEQ ID NO: 590378 - DNA, 482 bp, Homo sapiens; identical to SEQ ID NO: 540521
  misc_feature: HIJSMM301ARUX5.21.25.C03.1.454.light.4.raw

SEQ ID NO: 590379 - DNA, 492 bp, Homo sapiens; identical to SEQ ID NO: 564874
  misc_feature: HIJSMM301DO86X.11.25.C03.1.454.light.4.raw

SEQ ID NO: 590380 - DNA, 505 bp, Homo sapiens
  misc_feature: HIJSMM301DQQ4D.43.3.A03.1.454.light.4.raw
tgtgagtagtcacgaccggtgctcgatttagagagcgtcacagggggtggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccacactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgtt

SEQ ID NO: 590381 - DNA, 448 bp, Homo sapiens
  misc_feature: HIJSMM301AFC86.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgacccgtcctaagtcagcccaaggctcgccccctcggtcactctcgttcccaccctccctccgtgtctgat

SEQ ID NO: 590382 - DNA, 510 bp, Homo sapiens
  misc_feature: HIJSMM301DAMUC.16.46.E02.1.454.light.4.raw
  modified_base (424)..(424): a, c, t, g, unknown or other
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttanatacaggcaacaatacttttgtcttcggaactgggaccaaggtcaccgtcctaggtcagccaaggccaaccccactgtcactctcg

SEQ ID NO: 590383 - DNA, 505 bp, Homo sapiens; identical to SEQ ID NO: 559511
  misc_feature: HIJSMM301ERUBT.12.48.E04.1.454.light.4.raw

SEQ ID NO: 590384 - DNA, 506 bp, Homo sapiens
  misc_feature: HIJSMM301AD8X6.5.86.H09.1.454.light.4.raw
  modified_base (482)..(482): a, c, t, g, unknown or other
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggggacggacagcacgtcctcgtcgtcnccacgacgtcgtcccgcccgtccg

SEQ ID NO: 590385 - DNA, 503 bp, Homo sapiens; identical to SEQ ID NO: 538884
  misc_feature: HIJSMM301CZTCN.27.78.H01.1.454.light.4.raw

SEQ ID NO: 590386 - DNA, 486 bp, Homo sapiens
  misc_feature: HIJSMM301CZGFT.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggtcggagggaccaaactgaccgtcctaggtcagcccaaggctgccccctcggtcactctgttcccgccctcctctacgtgagct

SEQ ID NO: 590387 - DNA, 499 bp, Homo sapiens; identical to SEQ ID NO: 537800
  misc_feature: HIJSMM301AGESM.22.38.D05.1.454.light.4.raw

SEQ ID NO: 590388 - DNA, 494 bp, Homo sapiens; identical to SEQ ID NO: 552047
  misc_feature: HIJSMM301BJS33.26.72.G06.1.454.light.4.raw

SEQ ID NO: 590389 - DNA, 494 bp, Homo sapiens; identical to SEQ ID NO: 557656
  misc_feature: HIJSMM301AL8RL.22.5.A05.1.454.light.4.raw

SEQ ID NO: 590390 - DNA, 496 bp, Homo sapiens
  misc_feature: HIJSMM301EVWMA.52.57.F02.1.454.light.4.raw
cgcagtacgacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 590391 - DNA, 503 bp, Homo sapiens
  misc_feature: HIJSMM301AEQUX.49.68.G02.1.454.light.4.raw
agtcgagagacacgaccggtgctcgatttagtcgatagtgaagggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcg

SEQ ID NO: 590392 - DNA, 497 bp, Homo sapiens; identical to SEQ ID NO: 536371
  misc_feature: HIJSMM301B7KZI.16.78.H01.1.454.light.4.raw

SEQ ID NO: 590393 - DNA, 509 bp, Homo sapiens; identical to SEQ ID NO: 535670
  misc_feature: HIJSMM301B7JBA.47.23.C01.1.454.light.4.raw

SEQ ID NO: 590394 - DNA, 498 bp, Homo sapiens; identical to SEQ ID NO: 536173
  misc_feature: HIJSMM301EU8DV.12.86.H09.1.454.light.4.raw

SEQ ID NO: 590395 - DNA, 476 bp, Homo sapiens
  misc_feature: HIJSMM301C47AU.5.52.E08.1.454.light.4.raw
atcagacacgcacgaccggtgctcgatttagtcgagctctcagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcagtctccacagctcctgatctatttgggctcttatcgggcctccggggtccctgagaggttcagtggcagtggatcaggcacagactttacactgagaatcagcagagtggaggctgaggatgttggggtttattactgcatgcaagctctacaaccctattcactttcggccctgggaccagagtggata

SEQ ID NO: 590396 - DNA, 506 bp, Homo sapiens
  misc_feature: HIJSMM301BAJ0A.13.11.A11.1.454.light.4.raw
tcacgtactacacgaccggtgctcgatttagctacgactgcgggggtaaggaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgattggcacaacaacgcctggatcttcggacctgggaccacggtcaccgtacctggtcagcccaaggccaacccactgcactcttgttcccccg

SEQ ID NO: 590397 - DNA, 496 bp, Homo sapiens; identical to SEQ ID NO: 535541
  misc_feature: HIJSMM301BQFFB.3.33.C11.1.454.light.4.raw

SEQ ID NO: 590398 - DNA, 513 bp, Homo sapiens
  misc_feature: HIJSMM301EQR94.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaacgcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtccacttcc

SEQ ID NO: 590399 - DNA, 497 bp, Homo sapiens
  misc_feature: HIJSMM301AGW9V.41.20.B09.1.454.light.4.raw
  modified_base (473)..(473): a, c, t, g, unknown or other
tctatactatcacgaccggtgctcgatttagtgtagtgtgaagggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaaatggggccccatcaagatttagtggctttggaactgggacggagttcactctcaccatcaccggcctgcagcctgatgactttgcaacttattactgccagcaatatgacgtttacccgctcactttcggcggagggaccaaggtggagatcaaaggaactgtggctgcncatctgtcttcatcttcccgccta

SEQ ID NO: 590400 - DNA, 488 bp, Homo sapiens
  misc_feature: HIJSMM301BP8MZ.17.25.C03.1.454.light.4.raw
  modified_base (458)..(458): a, c, t, g, unknown or other
  modified_base (486)..(486): a, c, t, g, unknown or other
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccagggaccgaaagttagngaatcaaacgaaactgtggctgcaccanct

SEQ ID NO: 590401 - DNA, 490 bp, Homo sapiens; identical to SEQ ID NO: 538714
  misc_feature: HIJSMM301EQM28.11.12.B01.1.454.light.4.raw

SEQ ID NO: 590402 - DNA, 482 bp, Homo sapiens
  misc_feature: HIJSMM301C6QY1.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggaggcagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaagggaccaaggtggaagtcaaacgaactagtggctgcaccat

SEQ ID NO: 590403 - DNA, 513 bp, Homo sapiens; identical to SEQ ID NO: 535244
  misc_feature: HIJSMM301BQGQM.17.33.C11.1.454.light.4.raw

SEQ ID NO: 590404 - DNA, 503 bp, Homo sapiens; identical to SEQ ID NO: 551625
  misc_feature: HIJSMM301CRI1R.10.71.G05.1.454.light.4.raw

SEQ ID NO: 590405 - DNA, 454 bp, Homo sapiens; identical to SEQ ID NO: 535005
  misc_feature: HIJSMM301AC8PT.19.86.H09.1.454.light.4.raw

SEQ ID NO: 590406 - DNA, 490 bp, Homo sapiens; identical to SEQ ID NO: 577623
  misc_feature: HIJSMM301BAE7G.49.42.D09.1.454.light.4.raw

SEQ ID NO: 590407 - DNA, 505 bp, Homo sapiens
  misc_feature: HIJSMM301BQN0T.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattagagatcaaacgaactgtggctgcaccatctgtcttcatcttcccgcc

SEQ ID NO: 590408 - DNA, 444 bp, Homo sapiens; identical to SEQ ID NO: 535411
  misc_feature: HIJSMM301CD16C.8.73.G07.1.454.light.4.raw

SEQ ID NO: 590409 - DNA, 486 bp, Homo sapiens
  misc_feature: HIJSMM301CWCAN.46.26.C04.1.454.light.4.raw
  modified_base (445)..(445): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntccactttcggcggagggaccaaggtggagatcaaaacgaa

SEQ ID NO: 590410 - DNA, 493 bp, Homo sapiens
  misc_feature: HIJSMM301E3YWY.41.38.D05.1.454.light.4.raw
  modified_base (482)..(482): a, c, t, g, unknown or other
  modified_base (491)..(491): a, c, t, g, unknown or other
tctatactatcacgaccggtgctcgatttagtatctgatagttgggtttggggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggacgaacggttgtagaccaaacgaaactgtggctncacactctntc

SEQ ID NO: 590411 - DNA, 499 bp, Homo sapiens
  misc_feature: HIJSMM301EWU8B.40.29.C07.1.454.light.4.raw
tctagcgactcacgaccggtgctcgatttagagtgctacgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctgcaccatctgtcttcatt

SEQ ID NO: 590412 - DNA, 506 bp, Homo sapiens; identical to SEQ ID NO: 534969
  misc_feature: HIJSMM301CS7IF.18.37.D04.1.454.light.4.raw

SEQ ID NO: 590413 - DNA, 493 bp, Homo sapiens
  misc_feature: HIJSMM301C04VN.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattatgctgctcatatggaagtacctactcttttctcttcggaactgggaccacggtcaccgtcctaggtcagcccaaggccaaccc

SEQ ID NO: 590414 - DNA, 495 bp, Homo sapiens; identical to SEQ ID NO: 539267
  misc_feature: HIJSMM301DQ6L1.21.27.C05.1.454.light.4.raw

SEQ ID NO: 590415 - DNA, 525 bp, Homo sapiens
  misc_feature: HIJSMM301DHOWL.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctggctccatccttgggaacaaagctgccctcaccatcacgggggcccaggcagacgatgaatgtgattatcactgcgccctttatgtggggcgtggcagtttgggtggttcggcgggagggaaccaaactgaccgtccgtaggtcacgcccgaaggcctcgccccctcggtcacctcttccg

SEQ ID NO: 590416 - DNA, 503 bp, Homo sapiens
  misc_feature: HIJSMM301EEAJP.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaac

SEQ ID NO: 590417 - DNA, 487 bp, Homo sapiens
  misc_feature: HIJSMM301DCDGJ.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcaccc

SEQ ID NO: 590418 - DNA, 495 bp, Homo sapiens; identical to SEQ ID NO: 535596
  misc_feature: HIJSMM301EAMW4.10.79.H02.1.454.light.4.raw

SEQ ID NO: 590419 - DNA, 482 bp, Homo sapiens
  misc_feature: HIJSMM301B7R2Y.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcgagggaccaaggtgagatcaaacgaa

SEQ ID NO: 590420 - DNA, 507 bp, Homo sapiens
  misc_feature: HIJSMM301C9B8C.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttccggcccgtgggaccaagtaggatatcaaacgaactagtggctgcaccatctgtt

SEQ ID NO: 590421 - DNA, 503 bp, Homo sapiens; identical to SEQ ID NO: 565504
  misc_feature: HIJSMM301CDZHO.41.35.D02.1.454.light.4.raw

SEQ ID NO: 590422 - DNA, 503 bp, Homo sapiens; identical to SEQ ID NO: 536450
  misc_feature: HIJSMM301BPGBE.48.78.H01.1.454.light.4.raw

SEQ ID NO: 590423 - DNA, 496 bp, Homo sapiens
  misc_feature: HIJSMM301BIRHL.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcgg

SEQ ID NO: 590424 - DNA, 492 bp, Homo sapiens
  misc_feature: HIJSMM301D56IO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagtattttgcagtctattactgtcagcagtatggtcacgtacccaagtaacttttggccgaggggaccaagctggagatacaaacgaactgtggctgcaccat

SEQ ID NO: 590425 - DNA, 489 bp, Homo sapiens; identical to SEQ ID NO: 535386
  misc_feature: HIJSMM301BONYT.12.51.E07.1.454.light.4.raw

SEQ ID NO: 590426 - DNA, 507 bp, Homo sapiens; identical to SEQ ID NO: 535641
  misc_feature: HIJSMM301A6GCU.10.88.H11.1.454.light.4.raw

SEQ ID NO: 590427 - DNA, 490 bp, Homo sapiens
  misc_feature: HIJSMM301AV9P2.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgactaggtcagcccaagg

SEQ ID NO: 590428 - DNA, 515 bp, Homo sapiens
  misc_feature: HIJSMM301B4FHH.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgatttattactgcagcttatatacaggcaacaattacttttgtcttcggaactgggaccaaggtcaaccgtcctaggtcacgcccaaggcccaacccactgtcactctcg

SEQ ID NO: 590429 - DNA, 494 bp, Homo sapiens; identical to SEQ ID NO: 534994
  misc_feature: HIJSMM301AOGXV.27.78.H01.1.454.light.4.raw

SEQ ID NO: 590430 - DNA, 485 bp, Homo sapiens
  misc_feature: HIJSMM301AL9I0.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 590431 - DNA, 487 bp, Homo sapiens; identical to SEQ ID NO: 536536
  misc_feature: HIJSMM301AUROK.26.45.E01.1.454.light.4.raw

SEQ ID NO: 590432 - DNA, 478 bp, Homo sapiens; identical to SEQ ID NO: 557323
  misc_feature: HIJSMM301EG1V2.48.5.A05.1.454.light.4.raw

SEQ ID NO: 590433 - DNA, 528 bp, Homo sapiens
  misc_feature: HIJSMM301DQ166.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaagggaccgaacggtaggaaggtacaaacgaaactagtggctgcgaccaactctcgtcttctactcttcccgccctactctcgat

SEQ ID NO: 590434 - DNA, 489 bp, Homo sapiens
  misc_feature: HIJSMM301D5EEG.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgtacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatctgt

SEQ ID NO: 590435 - DNA, 492 bp, Homo sapiens
  misc_feature: HIJSMM301B7IF2.14.28.C06.1.454.light.4.raw
  modified_base (456)..(456): a, c, t, g, unknown or other
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaggtaaggnggtcaaacgaactgtggctgcaccatctgtcttcta

SEQ ID NO: 590436 - DNA, 485 bp, Homo sapiens; identical to SEQ ID NO: 544818
  misc_feature: HIJSMM301BKSTA.13.36.D03.1.454.light.4.raw

SEQ ID NO: 590437 - DNA, 501 bp, Homo sapiens
  misc_feature: HIJSMM301EHD72.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctggtcagcccaaggctgccccctggtca

SEQ ID NO: 590438 - DNA, 493 bp, Homo sapiens; identical to SEQ ID NO: 538136
  misc_feature: HIJSMM301AGTX7.47.64.F09.1.454.light.4.raw

SEQ ID NO: 590439 - DNA, 504 bp, Homo sapiens
  misc_feature: HIJSMM301CZK5U.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtgggctccggtccgaggatgaggctgactattactgtgcatcacgggacgcaacatgggatgaacaatctgagcggttgggtgttcggcggagggaccaaactgaccgtcctaggtcagcccaa

SEQ ID NO: 590440 - DNA, 447 bp, Homo sapiens; identical to SEQ ID NO: 535201
  misc_feature: HIJSMM301CGT7K.18.9.A09.1.454.light.4.raw

SEQ ID NO: 590441 - DNA, 511 bp, Homo sapiens
  misc_feature: HIJSMM301BD8EE.11.75.G09.1.454.light.4.raw
cgagagataccacgaccggtgctcgatttagtatagacatcgggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaatcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccgccctcc

SEQ ID NO: 590442 - DNA, 491 bp, Homo sapiens; identical to SEQ ID NO: 544714
  misc_feature: HIJSMM301AFQ8C.18.11.A11.1.454.light.4.raw

SEQ ID NO: 590443 - DNA, 500 bp, Homo sapiens
  misc_feature: HIJSMM301EKRK2.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtctttatcttccccg

SEQ ID NO: 590444 - DNA, 508 bp, Homo sapiens
  misc_feature: HIJSMM301C5O4V.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagtggccctcaggggtccctgatcgcttctcaggctccaagtctggcaacacggcctccctgaccgtctctgggctccagactgaggatgaggctgattattactgcagctcatattcaggcagcaaacagggattcggcggagggaccaagttgaccgtcctaggtcagcccaaggctgccccctcggtcactctgttcccaccct

SEQ ID NO: 590445 - DNA, 472 bp, Homo sapiens
  misc_feature: HIJSMM301BFT81.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagtattttgctagtttattactgtcagcaatataacaagtggccattcactttcggcccagggaccaagtggatatcaaacgaactgtggctgcaccatctgtcttcatcttccgccat

SEQ ID NO: 590446 - DNA, 491 bp, Homo sapiens
  misc_feature: HIJSMM301A8YA2.4.36.D03.1.454.light.4.raw
agcactgtagcacgaccggtgctcgatttagctgcgtcacgatctctcttgggggcaggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgtacgttcggccaagggaccaaggtaggaaatacaaacgaactagtggctgcacc

SEQ ID NO: 590447 - DNA, 500 bp, Homo sapiens
  misc_feature: HIJSMM301ANQHE.48.67.G01.1.454.light.4.raw
agtatacatacacgaccggtgctcgatttagagtatacatattgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 590448 - DNA, 545 bp, Homo sapiens
  misc_feature: HIJSMM301C8B66.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctacttggttggtggctgtgctattcggtcggagggaccgaacgactgaccgtcttaacgttacgtacgacccgaacggaacgcgtccccccgtccccggttccgtaaccgtcctcgtttcccgta

SEQ ID NO: 590449 - DNA, 383 bp, Homo sapiens; identical to SEQ ID NO: 553009
  misc_feature: HIJSMM301CIQU2.41.25.C03.1.454.light.4.raw

SEQ ID NO: 590450 - DNA, 511 bp, Homo sapiens; identical to SEQ ID NO: 537464
  misc_feature: HIJSMM301AJ2LE.7.34.D01.1.454.light.4.raw

SEQ ID NO: 590451 - DNA, 500 bp, Homo sapiens
  misc_feature: HIJSMM301EIMBW.41.12.B01.1.454.light.4.raw
tctatactatcacgaccggtgctcgatttagtagtgtagattccgcgggcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccaggggaccaagctcgagatcaaacgaa

SEQ ID NO: 590452 - DNA, 485 bp, Homo sapiens; identical to SEQ ID NO: 535749
  misc_feature: HIJSMM301AO2RP.46.35.D02.1.454.light.4.raw

SEQ ID NO: 590453 - DNA, 501 bp, Homo sapiens
  misc_feature: HIJSMM301BX4J0.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaattttattactgtcaacagcgtagcaactggcctcccactttcggcggagggaccaaggtggagatcaagcgaactgtggctgcaccatctgtcttcatcttcccgccta

SEQ ID NO: 590454 - DNA, 494 bp, Homo sapiens; identical to SEQ ID NO: 534994
  misc_feature: HIJSMM301CFQTE.27.78.H01.1.454.light.4.raw

SEQ ID NO: 590455 - DNA, 520 bp, Homo sapiens
  misc_feature: HIJSMM301A7DGF.53.20.B09.1.454.light.4.raw
cgcgtatacacacgaccggtgctcgatttagtgtagtgtgaagggggggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctgccccctcggtcactctgttcccgccctcctctcgtactgcgc

SEQ ID NO: 590456 - DNA, 454 bp, Homo sapiens; identical to SEQ ID NO: 534964
  misc_feature: HIJSMM301DGKSE.19.86.H09.1.454.light.4.raw

SEQ ID NO: 590457 - DNA, 516 bp, Homo sapiens; identical to SEQ ID NO: 536108
  misc_feature: HIJSMM301CSBF8.22.30.C08.1.454.light.4.raw

SEQ ID NO: 590458 - DNA, 474 bp, Homo sapiens; identical to SEQ ID NO: 561309
  misc_feature: HIJSMM301EJSEW.5.12.B01.1.454.light.4.raw

SEQ ID NO: 590459 - DNA, 520 bp, Homo sapiens; identical to SEQ ID NO: 543998
  misc_feature: HIJSMM301DZUJR.27.23.C01.1.454.light.4.raw

SEQ ID NO: 590460 - DNA, 491 bp, Homo sapiens
  misc_feature: HIJSMM301CRJP5.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttaccgccat

SEQ ID NO: 590461 - DNA, 493 bp, Homo sapiens
  misc_feature: HIJSMM301E2OIZ.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagaattaaacgaaactgtggctgcaccatctgtcttcatt

SEQ ID NO: 590462 - DNA, 508 bp, Homo sapiens; identical to SEQ ID NO: 552440
  misc_feature: HIJSMM301CMB51.5.24.C02.1.454.light.4.raw

SEQ ID NO: 590463 - DNA, 494 bp, Homo sapiens; identical to SEQ ID NO: 534994
  misc_feature: HIJSMM301B32FU.27.78.H01.1.454.light.4.raw

SEQ ID NO: 590464 - DNA, 454 bp, Homo sapiens
  misc_feature: HIJSMM301E4QEU.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggccaagctgaccgtcctaagtcagcccaaggctgccccctcggtcactctgttcccaccctcctccacgagagta

SEQ ID NO: 590465 - DNA, 507 bp, Homo sapiens
  misc_feature: HIJSMM301DFR5G.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccagggaccgaaggtcggaaagtcaaacgaactagtggcgtgcaccactctgtcttcatcttccccg

SEQ ID NO: 590466 - DNA, 507 bp, Homo sapiens; identical to SEQ ID NO: 535316
  misc_feature: HIJSMM301DQOBZ.18.37.D04.1.454.light.4.raw

SEQ ID NO: 590467 - DNA, 486 bp, Homo sapiens
  misc_feature: HIJSMM301C4CSW.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtcggagatacaaacgaa

SEQ ID NO: 590468 - DNA, 499 bp, Homo sapiens; identical to SEQ ID NO: 537739
  misc_feature: HIJSMM301DY1TO.12.86.H09.1.454.light.4.raw

SEQ ID NO: 590469 - DNA, 510 bp, Homo sapiens; identical to SEQ ID NO: 545115
  misc_feature: HIJSMM301A2YZZ.19.59.F04.1.454.light.4.raw

SEQ ID NO: 590470 - DNA, 484 bp, Homo sapiens
  misc_feature: HIJSMM301B1ZTZ.43.43.D10.1.454.light.4.raw
tgtgagtagtcacgaccggtgctcgatttagactagcagtaaggggggagtcagacccactcaggacacagcatggacatgagggtccccgctcagctcctggggctcctgctgctctggctcccaggtgccagatgtgccatccagatgacccagtctccttcctccctgtctgtgtctgtaggagacaaagtcaccatcacttgccgggcaagtcaggacattagagatgaattagcctggtatcagcagaaaccagggaaagcccctaagctcctgatctatgctgcatccattttacaaaatggggtcccgccaagattcagcggcagtggatctggcacagatttcactctcaccgtcagcagcctgcagtctgaagattttgcaactttattactgtctacaagattataaataccctcggacgttcggtccaggggaccgaaggtggatgtcaagacgaactgtggctgcaccatct

SEQ ID NO: 590471 - DNA, 510 bp, Homo sapiens; identical to SEQ ID NO: 560714
  misc_feature: HIJSMM301BID83.47.85.H08.1.454.light.4.raw

SEQ ID NO: 590472 - DNA, 483 bp, Homo sapiens
  misc_feature: HIJSMM301CH8SB.8.4.A04.1.454.light.4.raw
ctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggaggaccaagctgaccgtcctaggtcagcccc

SEQ ID NO: 590473 - DNA, 489 bp, Homo sapiens; identical to SEQ ID NO: 548339
  misc_feature: HIJSMM301BJWB6.16.86.H09.1.454.light.4.raw

SEQ ID NO: 590474 - DNA, 513 bp, Homo sapiens; identical to SEQ ID NO: 535244
  misc_feature: HIJSMM301E3R0A.17.33.C11.1.454.light.4.raw

SEQ ID NO: 590475 - DNA, 481 bp, Homo sapiens; identical to SEQ ID NO: 552290
  misc_feature: HIJSMM301ETG9K.7.76.G10.1.454.light.4.raw

SEQ ID NO: 590476 - DNA, 519 bp, Homo sapiens
  misc_feature: HIJSMM301AMC6H.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcagggagccctcactgactgtcgtccccagggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccgttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccaccctcct

SEQ ID NO: 590477 - DNA, 487 bp, Homo sapiens; identical to SEQ ID NO: 537009
  misc_feature: HIJSMM301ECZIO.12.88.H11.1.454.light.4.raw

SEQ ID NO: 590478 - DNA, 484 bp, Homo sapiens; identical to SEQ ID NO: 535240
  misc_feature: HIJSMM301DCG10.47.60.F05.1.454.light.4.raw

SEQ ID NO: 590479 - DNA, 489 bp, Homo sapiens; identical to SEQ ID NO: 543840
  misc_feature: HIJSMM301AU5HX.12.88.H11.1.454.light.4.raw

SEQ ID NO: 590480 - DNA, 379 bp, Homo sapiens
  misc_feature: HIJSMM301A38E4.22.28.C06.1.454.light.4.raw
  modified_base (371)..(371): a, c, t, g, unknown or other
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttggngtggtcgg

SEQ ID NO: 590481 - DNA, 487 bp, Homo sapiens
  misc_feature: HIJSMM301DWFZB.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattacctggactccagcctgaggacgaggctgactattactgctcagcatgggacagcggcctcaggacttatgtcttcggaactgggacccacgttaccgtcctaggtcagcccc

SEQ ID NO: 590482 - DNA, 485 bp, Homo sapiens; identical to SEQ ID NO: 538954
  misc_feature: HIJSMM301EWNT9.3.55.E11.1.454.light.4.raw

SEQ ID NO: 590483 - DNA, 488 bp, Homo sapiens; identical to SEQ ID NO: 535861
  misc_feature: HIJSMM301D6PS8.14.55.E11.1.454.light.4.raw

SEQ ID NO: 590484 - DNA, 513 bp, Homo sapiens; identical to SEQ ID NO: 548150
  misc_feature: HIJSMM301ETNBK.9.74.G08.1.454.light.4.raw

SEQ ID NO: 590485 - DNA, 518 bp, Homo sapiens
  misc_feature: HIJSMM301BJPXG.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgcccccctggtccactctcgttcccgccctcct

SEQ ID NO: 590486 - DNA, 444 bp, Homo sapiens; identical to SEQ ID NO: 534993
  misc_feature: HIJSMM301D8UD3.5.9.A09.1.454.light.4.raw

SEQ ID NO: 590487 - DNA, 484 bp, Homo sapiens
  misc_feature: HIJSMM301BCH0X.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagagttattcaactttcggccctgggaccaatgtggatatacaaacgaactgtggctgcaccatctgtt

SEQ ID NO: 590488 - DNA, 495 bp, Homo sapiens; identical to SEQ ID NO: 550059
  misc_feature: HIJSMM301BB1R6.49.22.B11.1.454.light.4.raw

SEQ ID NO: 590489 - DNA, 486 bp, Homo sapiens; identical to SEQ ID NO: 535043
  misc_feature: HIJSMM301CYOGO.46.35.D02.1.454.light.4.raw

SEQ ID NO: 590490 - DNA, 494 bp, Homo sapiens; identical to SEQ ID NO: 540110
  misc_feature: HIJSMM301EQJ0U.51.71.G05.1.454.light.4.raw

SEQ ID NO: 590491 - DNA, 521 bp, Homo sapiens; identical to SEQ ID NO: 538715
  misc_feature: HIJSMM301ELG0G.27.23.C01.1.454.light.4.raw

SEQ ID NO: 590492 - DNA, 493 bp, Homo sapiens
  misc_feature: HIJSMM301B7NQL.40.67.G01.1.454.light.4.raw
tctagcgactcacgaccggtgctcgatttagagtatacatattgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcat

SEQ ID NO: 590493 - DNA, 479 bp, Homo sapiens; identical to SEQ ID NO: 535118
  misc_feature: HIJSMM301CCJP0.13.59.F04.1.454.light.4.raw

SEQ ID NO: 590494 - DNA, 503 bp, Homo sapiens; identical to SEQ ID NO: 565820
  misc_feature: HIJSMM301BURIF.18.59.F04.1.454.light.4.raw

SEQ ID NO: 590495 - DNA, 498 bp, Homo sapiens
  misc_feature: HIJSMM301D0XPL.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcattatagtagaaaactaaccggccctcagggatcccagaccgaatctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 590496 - DNA, 474 bp, Homo sapiens; identical to SEQ ID NO: 558221
  misc_feature: HIJSMM301AXRPK.12.49.E05.1.454.light.4.raw

SEQ ID NO: 590497 - DNA, 494 bp, Homo sapiens
  misc_feature: HIJSMM301EUEIY.4.52.E08.1.454.light.4.raw
agcactgtagcacgaccggtgctcgatttagtcgagctctcagagagaaagggggaggaactgctcagttagggcccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggtattttgctagtttattactgtcagcagcgtagcaactggcctctgctcactttcggcggagggaccgaaggtggagatacaaacgaactgtggctgcaccta

SEQ ID NO: 590498 - DNA, 490 bp, Homo sapiens
  misc_feature: HIJSMM301EBY3W.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatccaccagggccactggtactcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgtt

SEQ ID NO: 590499 - DNA, 504 bp, Homo sapiens
  misc_feature: HIJSMM301BZLFL.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcacctttcggcggagggaccaaggtggacctcaaacgactgtggctgcaccatctgtcttcatcttcccgc

SEQ ID NO: 590500 - DNA, 491 bp, Homo sapiens
  misc_feature: HIJSMM301EHEO9.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtgggttctgagacagatttcagtctcaccatccgtgacctgcagcctgaagattttgcaacttacttttgtcaacagactaactcattccctcgcagttttggcctaggggaccaagggtgagatcaaacgaactagtggctgcaccatctgtcttcatt

SEQ ID NO: 590501 - DNA, 476 bp, Homo sapiens; identical to SEQ ID NO: 538611
  misc_feature: HIJSMM301DJJZE.7.81.H04.1.454.light.4.raw

SEQ ID NO: 590502 - DNA, 473 bp, Homo sapiens; identical to SEQ ID NO: 538711
  misc_feature: HIJSMM301C1JI5.11.17.B06.1.454.light.4.raw

SEQ ID NO: 590503 - DNA, 486 bp, Homo sapiens
  misc_feature: HIJSMM301AJ20Y.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtgctgcaccatctgt

SEQ ID NO: 590504 - DNA, 499 bp, Homo sapiens
  misc_feature: HIJSMM301D7AJL.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaagctgcccctcggtcact

SEQ ID NO: 590505 - DNA, 498 bp, Homo sapiens
  misc_feature: HIJSMM301C9KKJ.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagttacttactgtctagacaataattcttactactcctccgacgttcgtcggagggacggaacggaggtaggagactaacgaaact

SEQ ID NO: 590506 - DNA, 493 bp, Homo sapiens
  misc_feature: HIJSMM301AJM8D.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtaggaaatacaaacgaactgtggctgcaccactctgtcttcta

SEQ ID NO: 590507 - DNA, 474 bp, Homo sapiens
  misc_feature: HIJSMM301C43PK.40.1.A01.1.454.light.4.raw
tctagcgactcacgaccggtgctcgatttagacgtctcatcagggggcaggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaagtctcctgttttggcagggaccaaggtggagatacaaacgaactgtggctgcaccta

SEQ ID NO: 590508 - DNA, 515 bp, Homo sapiens; identical to SEQ ID NO: 557280
  misc_feature: HIJSMM301ENC0E.15.86.H09.1.454.light.4.raw

SEQ ID NO: 590509 - DNA, 489 bp, Homo sapiens; identical to SEQ ID NO: 576120
  misc_feature: HIJSMM301CZXP9.26.78.H01.1.454.light.4.raw

SEQ ID NO: 590510 - DNA, 484 bp, Homo sapiens; identical to SEQ ID NO: 535400
  misc_feature: HIJSMM301CMFQ9.46.26.C04.1.454.light.4.raw

SEQ ID NO: 590511 - DNA, 486 bp, Homo sapiens; identical to SEQ ID NO: 535290
  misc_feature: HIJSMM301B23AH.3.12.B01.1.454.light.4.raw

SEQ ID NO: 590512 - DNA, 494 bp, Homo sapiens
  misc_feature: HIJSMM301APJXV.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggcct

SEQ ID NO: 590513 - DNA, 510 bp, Homo sapiens
  misc_feature: HIJSMM301D4TXD.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggccccaggcagatgatgagtgtgattattactgtgtgctctatatgggcagtggcgtttggggtgtttcggcggagggaccaagctgaccgttcg

SEQ ID NO: 590514 - DNA, 516 bp, Homo sapiens
  misc_feature: HIJSMM301B1DXN.40.12.B01.1.454.light.4.raw
tctagcgactcacgaccggtgctcgatttagtagtgtagattccgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcgggagggaccaagctgaccgtcctaggtcagcccaaggcctgccccctcggtcactctgttccc

SEQ ID NO: 590515 - DNA, 504 bp, Homo sapiens
  misc_feature: HIJSMM301CPKO9.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggagaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaagtggatatcaaacgaactgtggctgcaccatctgtctt

SEQ ID NO: 590516 - DNA, 489 bp, Homo sapiens; identical to SEQ ID NO: 537328
  misc_feature: HIJSMM301BBP5G.13.5.A05.1.454.light.4.raw

SEQ ID NO: 590517 - DNA, 509 bp, Homo sapiens; identical to SEQ ID NO: 553073
  misc_feature: HIJSMM301AZ1I6.16.1.A01.1.454.light.4.raw

SEQ ID NO: 590518 - DNA, 491 bp, Homo sapiens
  misc_feature: HIJSMM301AN2XS.26.23.C01.1.454.light.4.raw
agactatactcacgaccggtgctcgatttagtacacgtgattagggattggggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggcgacgggaccaaggtggaagtacaagcgaactgtggctgcaccatctgtt

SEQ ID NO: 590519 - DNA, 445 bp, Homo sapiens
  misc_feature: HIJSMM301CRFGV.51.83.H06.1.454.light.4.raw
cgatcgtatacacgaccggtgctcgatttagatcacgtgcgtcgcggggtcctgggcccagtctgtcctgactcagccaccctcagcgtctgggacccccgggcggagggtcgccatctcttgttctggaagcagctccaacatcggaagtaatgctgtcaactggtatcaacaactcccaggatcggcccccagactcctcatttttaataatgatcagcgggcctcaggggtccctgaccgattctctgcctccaagtcaggcacctcagcctccctggccatcagtgggctccagtctgaggatgaggctgattattattgtgcagcgtgggatgacagcctgtatatgtctctcttcggaggaggcacccagctgaccgtcctcggtcagcccaaggctgccccctcggtcactctgttcccaccctcctctcgtagcact

SEQ ID NO: 590520 - DNA, 497 bp, Homo sapiens
  misc_feature: HIJSMM301EPEXD.49.62.F07.1.454.light.4.raw
agtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccccactgtcta

SEQ ID NO: 590521 - DNA, 470 bp, Homo sapiens
  misc_feature: HIJSMM301DIBMR.19.74.G08.1.454.light.4.raw
tactctcgtgcacgaccggtgctcgatttagtagctctatcagggtgctgctaatgctctgggcccctggatccagtggggatattgtgatgacccaggctccactctcctcacctgtcacccttggacagccggcctccatctcctgcacttctagccaaaacctcgtgcacagtgatggaaacacctacttgagttggcttcagcagaggccaggccagcctccaagactcctaatctctaagatttctaaccggttctctggggtcccagacagattcagtggcagtggggcaggggcagatttcacactgaggatcagcagggtggaacctgaggatgtcgcgatttattactgcatgcaagctacacattttcctcgaacttttggccaggggaccaggctggagatcaagcgaactgtggctgcaccatctgtcttcatcttcccgccatctgacacgagagta

SEQ ID NO: 590522 - DNA, 513 bp, Homo sapiens; identical to SEQ ID NO: 541387
  misc_feature: HIJSMM301D5TV9.17.33.C11.1.454.light.4.raw

SEQ ID NO: 590523 - DNA, 487 bp, Homo sapiens; identical to SEQ ID NO: 537208
  misc_feature: HIJSMM301DAK35.3.55.E11.1.454.light.4.raw

SEQ ID NO: 590524 - DNA, 495 bp, Homo sapiens; identical to SEQ ID NO: 551380
  misc_feature: HIJSMM301AOKY8.51.5.A05.1.454.light.4.raw

SEQ ID NO: 590525 - DNA, 511 bp, Homo sapiens
  misc_feature: HIJSMM301BRRMA.49.30.C08.1.454.light.4.raw
agtcgagagacacgaccggtgctcgatttagtctgacgtcaaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatacaaacgaactgtggctgcaccatctgtcttcatccttcccgcctatctaa

SEQ ID NO: 590526 - DNA, 487 bp, Homo sapiens; identical to SEQ ID NO: 536179
  misc_feature: HIJSMM301CTSXL.19.57.F02.1.454.light.4.raw

SEQ ID NO: 590527 - DNA, 441 bp, Homo sapiens; identical to SEQ ID NO: 534971
  misc_feature: HIJSMM301C76R0.11.3.A03.1.454.light.4.raw

SEQ ID NO: 590528 - DNA, 481 bp, Homo sapiens
  misc_feature: HIJSMM301CME35.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatagtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgt

SEQ ID NO: 590529 - DNA, 517 bp, Homo sapiens
  misc_feature: HIJSMM301BJ4OU.41.34.D01.1.454.light.4.raw
tctatactatcacgaccggtgctcgatttagatcgtctgtgttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgtt

SEQ ID NO: 590530 - DNA, 481 bp, Homo sapiens; identical to SEQ ID NO: 535993
  misc_feature: HIJSMM301D25Y7.21.25.C03.1.454.light.4.raw

SEQ ID NO: 590531 - DNA, 502 bp, Homo sapiens
  misc_feature: HIJSMM301BBHDB.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtcgaggatgaggctgactattactgtgcatcacggggacgcaacatgggatgacaatctgagcggttgggtgttcggcggagggaccaaactgaccgtcctaggtcagcccaa

SEQ ID NO: 590532 - DNA, 509 bp, Homo sapiens; identical to SEQ ID NO: 537131
  misc_feature: HIJSMM301EI3BF.17.33.C11.1.454.light.4.raw

SEQ ID NO: 590533 - DNA, 488 bp, Homo sapiens
  misc_feature: HIJSMM301D6J82.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccgaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccca

SEQ ID NO: 590534 - DNA, 476 bp, Homo sapiens
  misc_feature: HIJSMM301BLN2K.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 590535 - DNA, 494 bp, Homo sapiens; identical to SEQ ID NO: 534994
  misc_feature: HIJSMM301A4G09.27.78.H01.1.454.light.4.raw

SEQ ID NO: 590536 - DNA, 506 bp, Homo sapiens
  misc_feature: HIJSMM301AGG58.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggcctcaggggtttctgttcgcttctctggctccaagtctggcagcacggcctccctgaccatctctgggctccaggctgaggacgaggctgactatttattgcagttcattatggtagtatgaagacttcttgtgtagttttcggcgggagggaccaagctggaccgtcctgagtcacgcccgaaggctcccgg

SEQ ID NO: 590537 - DNA, 508 bp, Homo sapiens
  misc_feature: HIJSMM301BS21Y.48.58.F03.1.454.light.4.raw
agtatacatacacgaccggtgctcgatttagtctgatcgagaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcaccgtgggagttcggcggcgggaccaagctgaccgtctaggtcagccaaggctgccccctcggtcactctgtt

SEQ ID NO: 590538 - DNA, 507 bp, Homo sapiens
  misc_feature: HIJSMM301CUZCU.49.81.H04.1.454.light.4.raw
agtcgagagacacgaccggtgctcgatttagtagtgtagattcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgtactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggtcact

SEQ ID NO: 590539 - DNA, 490 bp, Homo sapiens
  misc_feature: HIJSMM301CDRO4.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgcctacttttggcctaggggaccaagctggagatcaggcgaacg

SEQ ID NO: 590540 - DNA, 495 bp, Homo sapiens; identical to SEQ ID NO: 554164
  misc_feature: HIJSMM301BYP05.27.78.H01.1.454.light.4.raw

SEQ ID NO: 590541 - DNA, 503 bp, Homo sapiens
  misc_feature: HIJSMM301EYPJ8.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcgg

SEQ ID NO: 590542 - DNA, 489 bp, Homo sapiens
  misc_feature: HIJSMM301C52JK.17.25.C03.1.454.light.4.raw
cgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccagggaccaaagttgagatcaaacgaactgtggctgcaccatctgtt

SEQ ID NO: 590543 - DNA, 485 bp, Homo sapiens; identical to SEQ ID NO: 536307
  misc_feature: HIJSMM301CVFZK.46.35.D02.1.454.light.4.raw

SEQ ID NO: 590544 - DNA, 507 bp, Homo sapiens; identical to SEQ ID NO: 548333
  misc_feature: HIJSMM301DHK2U.4.57.F02.1.454.light.4.raw

SEQ ID NO: 590545 - DNA, 446 bp, Homo sapiens; identical to SEQ ID NO: 557437
  misc_feature: HIJSMM301DW0N3.5.9.A09.1.454.light.4.raw

SEQ ID NO: 590546 - DNA, 486 bp, Homo sapiens
  misc_feature: HIJSMM301DEDDT.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcacatctgtt

SEQ ID NO: 590547 - DNA, 490 bp, Homo sapiens; identical to SEQ ID NO: 563795
  misc_feature: HIJSMM301BKE1Z.14.55.E11.1.454.light.4.raw

SEQ ID NO: 590548 - DNA, 470 bp, Homo sapiens
  misc_feature: HIJSMM301AHXCY.49.27.C05.1.454.light.4.raw
agtcgagagacacgaccggtgctcgatttagacgcgatcgaagggtttggggaggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaa

SEQ ID NO: 590549 - DNA, 511 bp, Homo sapiens
  misc_feature: HIJSMM301CFKTQ.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaaggctgccccctcggtcactctgttcccgt

SEQ ID NO: 590550 - DNA, 495 bp, Homo sapiens; identical to SEQ ID NO: 535486
  misc_feature: HIJSMM301CMISO.26.72.G06.1.454.light.4.raw

SEQ ID NO: 590551 - DNA, 489 bp, Homo sapiens; identical to SEQ ID NO: 546040
  misc_feature: HIJSMM301A3LL0.11.12.B01.1.454.light.4.raw

SEQ ID NO: 590552 - DNA, 383 bp, Homo sapiens; identical to SEQ ID NO: 447524
  misc_feature: HIJSMM301DSE9C.41.26.C04.1.454.light.4.raw

SEQ ID NO: 590553 - DNA, 505 bp, Homo sapiens; identical to SEQ ID NO: 587679
  misc_feature: HIJSMM301ED09H.48.57.F02.1.454.light.4.raw

SEQ ID NO: 590554 - DNA, 502 bp, Homo sapiens; identical to SEQ ID NO: 539314
  misc_feature: HIJSMM301DU9OJ.21.81.H04.1.454.light.4.raw

SEQ ID NO: 590555 - DNA, 476 bp, Homo sapiens
  misc_feature: HIJSMM301DOPO7.40.52.E08.1.454.light.4.raw
tctagcgactcacgaccggtgctcgatttagtcgagctctcagagagaaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctccctgaccatctctgggctccaagctgaggacgaggctgtttatttctgcagctcatatacaagcagcaacactctggtgttcggcggagggaccaagctgaccgt

SEQ ID NO: 590556 - DNA, 497 bp, Homo sapiens; identical to SEQ ID NO: 537300
  misc_feature: HIJSMM301AQT65.9.53.E09.1.454.light.4.raw

SEQ ID NO: 590557 - DNA, 518 bp, Homo sapiens
  misc_feature: HIJSMM301AWK8C.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactggcatctacccggcaatccggggtccctgaccgattcagtggcagcgggtctgggacagatttcactctcaccatcagcagcctgcaggctgaagatgtggcagtttattactgtcaaacagttttctcgggcgttggtccaacgggaaccgaacggtaggaaagtacaaacgaaactagtaggtccgtggcaccaatctgtcttctatcttccccg

SEQ ID NO: 590558 - DNA, 500 bp, Homo sapiens
  misc_feature: HIJSMM301CR69G.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggttagttacacttatgtcttcggaattgggacgacggtcaccgtcctaggtcagcccaaggccaacccca

SEQ ID NO: 590559 - DNA, 460 bp, Homo sapiens; identical to SEQ ID NO: 536053
  misc_feature: HIJSMM301AY28Y.22.28.C06.1.454.light.4.raw

SEQ ID NO: 590560 - DNA, 485 bp, Homo sapiens
  misc_feature: HIJSMM301BVR7M.48.56.F01.1.454.light.4.raw
agtatacatacacgaccggtgctcgatttagcagacgtctgaacacacaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggccatcactgggctccagactgaggatgaggctgattattactgccagtcctatgacagcaacctgagcggttgggtgttcggcggagggacca

SEQ ID NO: 590561 - DNA, 490 bp, Homo sapiens
  misc_feature: HIJSMM301BA3GS.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcgccaagggacacgactggagattaaacgaactgtggctgcaccatctgtcttcatcc

SEQ ID NO: 590562 - DNA, 501 bp, Homo sapiens
  misc_feature: HIJSMM301BCDA4.48.37.D04.1.454.light.4.raw
agtatacatacacgaccggtgctcgatttagtagcatactgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 590563 - DNA, 483 bp, Homo sapiens; identical to SEQ ID NO: 535413
  misc_feature: HIJSMM301DYAR7.26.78.H01.1.454.light.4.raw

SEQ ID NO: 590564 - DNA, 474 bp, Homo sapiens
  misc_feature: HIJSMM301A1DRO.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccaaggtcggagatcaaacgaa

SEQ ID NO: 590565 - DNA, 495 bp, Homo sapiens; identical to SEQ ID NO: 538942
  misc_feature: HIJSMM301AQXC5.43.61.F06.1.454.light.4.raw

SEQ ID NO: 590566 - DNA, 506 bp, Homo sapiens
  misc_feature: HIJSMM301DBLVC.7.71.G05.1.454.light.4.raw
  modified_base (206)..(206): a, c, t, g, unknown or other
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactacgtggctgcaccatctgtt

SEQ ID NO: 590567 - DNA, 484 bp, Homo sapiens; identical to SEQ ID NO: 535240
  misc_feature: HIJSMM301EGJAR.47.60.F05.1.454.light.4.raw

SEQ ID NO: 590568 - DNA, 504 bp, Homo sapiens
  misc_feature: HIJSMM301BNVSY.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtaggatatcaaacgaactagtggctgcaccatct

SEQ ID NO: 590569 - DNA, 498 bp, Homo sapiens
  misc_feature: HIJSMM301D04O0.48.87.H10.1.454.light.4.raw
agtatacatacacgaccggtgctcgatttagcagtactgcgttgggtttagggactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 590570 - DNA, 507 bp, Homo sapiens
  misc_feature: HIJSMM301AKNB9.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccgaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtca

SEQ ID NO: 590571 - DNA, 475 bp, Homo sapiens; identical to SEQ ID NO: 544617
  misc_feature: HIJSMM301AGRJV.13.76.G10.1.454.light.4.raw

SEQ ID NO: 590572 - DNA, 491 bp, Homo sapiens; identical to SEQ ID NO: 550287
  misc_feature: HIJSMM301BP0X4.14.36.D03.1.454.light.4.raw

SEQ ID NO: 590573 - DNA, 491 bp, Homo sapiens; identical to SEQ ID NO: 542310
  misc_feature: HIJSMM301CGECS.22.65.F10.1.454.light.4.raw

SEQ ID NO: 590574 - DNA, 497 bp, Homo sapiens
  misc_feature: HIJSMM301E4JZI.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggtccagggaccgacggtggagatcagacgaactgtggctgcaccatctgtcttctatcttcccg

SEQ ID NO: 590575 - DNA, 502 bp, Homo sapiens
  misc_feature: HIJSMM301D7A1F.41.35.D02.1.454.light.4.raw
tctatactatcacgaccggtgctcgattagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 590576 - DNA, 507 bp, Homo sapiens; identical to SEQ ID NO: 585758
  misc_feature: HIJSMM301C8OP0.18.37.D04.1.454.light.4.raw

SEQ ID NO: 590577 - DNA, 497 bp, Homo sapiens
  misc_feature: HIJSMM301DLYWN.22.86.H09.1.454.light.4.raw
  modified_base (413)..(413): a, c, t, g, unknown or other
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttggggtnttcggcggagggaccaagctgaccgtcctaggtcagcccaaggctgccccctcggtcactctgttccccgccctcctcacgtcg

SEQ ID NO: 590578 - DNA, 484 bp, Homo sapiens
  misc_feature: HIJSMM301ETJ6V.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcctacgtaga

SEQ ID NO: 590579 - DNA, 507 bp, Homo sapiens
  misc_feature: HIJSMM301DADSY.3.79.H02.1.454.light.4.raw
  modified_base (244)..(244): a, c, t, g, unknown or other
agacgcactccacgaccggtgctcgatttagtgtcacacgaaggggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttanatctctgtctcctggtaccaacaacacccaggcaaagccccaaactcatcatttatgatgtcactgctcggccctcaggggtttctcatcgcttttctggctccaagtctggcaccacggcctccctgaccatctcggggctccaggctgaggacgaggctgcttattactgtcagctcatatacaaggagcaccactctcgtggtatttggtggagggaccaagctgaccgtcctaggtcagcccaaggctgccccctcggt

SEQ ID NO: 590580 - DNA, 497 bp, Homo sapiens
  misc_feature: HIJSMM301BZGFC.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattataacttcgtggacgttcggccaagggaccaaaggtggatatcagacgaactgtggctgca

SEQ ID NO: 590581 - DNA, 503 bp, Homo sapiens
  misc_feature: HIJSMM301DCDCA.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactggaccaaggtcaccgtcctaggtcagcccaaggccaacccactgtca

SEQ ID NO: 590582 - DNA, 444 bp, Homo sapiens; identical to SEQ ID NO: 535192
  misc_feature: HIJSMM301ETZK4.5.9.A09.1.454.light.4.raw

SEQ ID NO: 590583 - DNA, 504 bp, Homo sapiens
  misc_feature: HIJSMM301AMM4W.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 590584 - DNA, 507 bp, Homo sapiens; identical to SEQ ID NO: 536226
  misc_feature: HIJSMM301BTR5Z.18.37.D04.1.454.light.4.raw

SEQ ID NO: 590585 - DNA, 487 bp, Homo sapiens; identical to SEQ ID NO: 576529
  misc_feature: HIJSMM301B0W6R.17.26.C04.1.454.light.4.raw

SEQ ID NO: 590586 - DNA, 486 bp, Homo sapiens; identical to SEQ ID NO: 535043
  misc_feature: HIJSMM301EELMC.46.35.D02.1.454.light.4.raw

SEQ ID NO: 590587 - DNA, 508 bp, Homo sapiens
  misc_feature: HIJSMM301DV5VB.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 590588 - DNA, 497 bp, Homo sapiens; identical to SEQ ID NO: 536371
  misc_feature: HIJSMM301EZPH4.16.78.H01.1.454.light.4.raw

SEQ ID NO: 590589 - DNA, 495 bp, Homo sapiens
  misc_feature: HIJSMM301C1KTQ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtacgacgtggcctccggggccgcttcgtccgtcggacgaacgtaggatagataacaaccaagtagtcgtg

SEQ ID NO: 590590 - DNA, 522 bp, Homo sapiens; identical to SEQ ID NO: 541090
  misc_feature: HIJSMM301AOQC6.27.23.C01.1.454.light.4.raw

SEQ ID NO: 590591 - DNA, 505 bp, Homo sapiens
  misc_feature: HIJSMM301DYP9J.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaaacgaccctccgggatccctgagagattctctggctccagctcagggactatggccaccttgactatcagtgggcccaagtggaggatgaagctgactactactgttactcaatagagaacagtgataaatttctgggtgttcggcggacgggacaaaactgaccgtcctaggtcagcccaaggctgcccctcggtcactctgtt

SEQ ID NO: 590592 - DNA, 486 bp, Homo sapiens; identical to SEQ ID NO: 535043
  misc_feature: HIJSMM301AVO24.46.35.D02.1.454.light.4.raw

SEQ ID NO: 590593 - DNA, 493 bp, Homo sapiens
  misc_feature: HIJSMM301EUZMT.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatcctgtcttcatcttcccgccat

SEQ ID NO: 590594 - DNA, 494 bp, Homo sapiens
  misc_feature: HIJSMM301B4CPU.53.64.F09.1.454.light.4.raw
cgcgtatacacacgaccggtgctcgatttagcgcgtatacaaggggtctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccccaggaacggcccccagactcctcattcatgacaataaccagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtctaggtcagccc

SEQ ID NO: 590595 - DNA, 491 bp, Homo sapiens; identical to SEQ ID NO: 544714
  misc_feature: HIJSMM301DUZV6.18.11.A11.1.454.light.4.raw

SEQ ID NO: 590596 - DNA, 460 bp, Homo sapiens; identical to SEQ ID NO: 536053
  misc_feature: HIJSMM301DRYF4.22.28.C06.1.454.light.4.raw

SEQ ID NO: 590597 - DNA, 518 bp, Homo sapiens
  misc_feature: HIJSMM301A6ZT9.49.23.C01.1.454.light.4.raw
agtcgagagacacgaccggtgctcgatttagtacacgtgattagggattgggggtgggctcaggaggcagagctctgggaatctcaccatggcctggacccctctcctgcctccccctcctcactttctgcacagtctctgaggcctcctatgagctgacacagtcaccctcgctgtcagtgtccccaggacaaacggccaggatcacctgctctggagatgcattgaccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatggagggtgattactactgttactcaacagacattactactactcatagggtgttcggcggagggaccaagctgaccgtcctaggtcagcccaaggctgccccctcggtccactctcgttcccaccctt

SEQ ID NO: 590598 - DNA, 498 bp, Homo sapiens
  misc_feature: HIJSMM301B5H37.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactggtggctgcaccatctgtt

SEQ ID NO: 590599 - DNA, 443 bp, Homo sapiens
  misc_feature: HIJSMM301DARKO.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagccaaggctgccccctcggtcactctgttcccaccctcctctagagacacg

SEQ ID NO: 590600 - DNA, 500 bp, Homo sapiens; identical to SEQ ID NO: 546095
  misc_feature: HIJSMM301A1NAY.52.78.H01.1.454.light.4.raw

SEQ ID NO: 590601 - DNA, 498 bp, Homo sapiens
  misc_feature: HIJSMM301BJ541.52.17.B06.1.454.light.4.raw
cgcagtacgacacgaccggtgctcgatttagtcgatagtgaagggcacgaccggtgctcgatttagtcgatagtgaaggggtgatcaggactcctcagttcaccttctcacaatgaggctccctgctcagctcctggggctgctaatgctctgggtctctggatccagtggacaaattgtgctgactcagtctccactctccctgcccgtcacccctggagagccggcctccatctcctgcaggtctagtcagagcctcctgcattataatggataccagtatttggactggtacctacagaaggcagggcagtctccacagctcctgatctatttgggttcttatcgggcctccggggtccctgacaggttcagtggcagcggatcaggcacaaattttacactgagaatcagcagagtggaggcagaggatgttggggtttattattgcatgcaaggtctacaaactcaactggacgttcggccaagggacctaaa

SEQ ID NO: 590602 - DNA, 486 bp, Homo sapiens
  misc_feature: HIJSMM301EDDHV.47.30.C08.1.454.light.4.raw
agctcacgtacacgaccggtgctcgatttagtctgacgtcaaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtaatcataatctccccatttcggccctgggaccaaagtggatatcaaacgaactgtggctgcaccatctgtt

SEQ ID NO: 590603 - DNA, 444 bp, Homo sapiens; identical to SEQ ID NO: 535192
  misc_feature: HIJSMM301CA9BS.5.9.A09.1.454.light.4.raw

SEQ ID NO: 590604 - DNA, 519 bp, Homo sapiens
  misc_feature: HIJSMM301BQ5HZ.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggcactctgttcccaccct

SEQ ID NO: 590605 - DNA, 499 bp, Homo sapiens; identical to SEQ ID NO: 543600
  misc_feature: HIJSMM301ALT0E.14.23.C01.1.454.light.4.raw

SEQ ID NO: 590606 - DNA, 506 bp, Homo sapiens
  misc_feature: HIJSMM301EOU15.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtccactctcg

SEQ ID NO: 590607 - DNA, 495 bp, Homo sapiens; identical to SEQ ID NO: 555261
  misc_feature: HIJSMM301EGX21.51.71.G05.1.454.light.4.raw

SEQ ID NO: 590608 - DNA, 472 bp, Homo sapiens
  misc_feature: HIJSMM301DJUI7.3.38.D05.1.454.light.4.raw
  modified_base (418)..(418): a, c, t, g, unknown or other
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacanagtttcactacccctctcactttcggcggggggaccaaggtgaggatcaacgaa

SEQ ID NO: 590609 - DNA, 498 bp, Homo sapiens
  misc_feature: HIJSMM301C2BLW.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcagcccaaggctcg

SEQ ID NO: 590610 - DNA, 495 bp, Homo sapiens
  misc_feature: HIJSMM301CPEBD.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtacttttggccagggaccaagctggagatcaaacgaactgtggctgcaccatctgtcttcta

SEQ ID NO: 590611 - DNA, 494 bp, Homo sapiens
  misc_feature: HIJSMM301CEJ57.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagttactcctccgaggctcactttcggcggagggaccaaggtggagatcaaacgaactgtggcg

SEQ ID NO: 590612 - DNA, 494 bp, Homo sapiens
  misc_feature: HIJSMM301AK29L.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggacccaaggtcgtaggagtactaacgaactacg

SEQ ID NO: 590613 - DNA, 508 bp, Homo sapiens; identical to SEQ ID NO: 565391
  misc_feature: HIJSMM301EMXSA.5.58.F03.1.454.light.4.raw

SEQ ID NO: 590614 - DNA, 511 bp, Homo sapiens; identical to SEQ ID NO: 547172
  misc_feature: HIJSMM301A3O3O.11.57.F02.1.454.light.4.raw

SEQ ID NO: 590615 - DNA, 503 bp, Homo sapiens; identical to SEQ ID NO: 547760
  misc_feature: HIJSMM301CTGNQ.8.19.B08.1.454.light.4.raw

SEQ ID NO: 590616 - DNA, 496 bp, Homo sapiens
  misc_feature: HIJSMM301D5436.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaaggccaacccc

SEQ ID NO: 590617 - DNA, 488 bp, Homo sapiens; identical to SEQ ID NO: 535861
  misc_feature: HIJSMM301DD3HN.14.55.E11.1.454.light.4.raw

SEQ ID NO: 590618 - DNA, 478 bp, Homo sapiens; identical to SEQ ID NO: 535129
  misc_feature: HIJSMM301EZ39K.11.11.A11.1.454.light.4.raw

SEQ ID NO: 590619 - DNA, 487 bp, Homo sapiens; identical to SEQ ID NO: 535583
  misc_feature: HIJSMM301C1WHS.22.73.G07.1.454.light.4.raw

SEQ ID NO: 590620 - DNA, 494 bp, Homo sapiens; identical to SEQ ID NO: 534994
  misc_feature: HIJSMM301BY5RD.27.78.H01.1.454.light.4.raw

SEQ ID NO: 590621 - DNA, 503 bp, Homo sapiens
  misc_feature: HIJSMM301BFVWO.40.58.F03.1.454.light.4.raw
tctagcgactcacgaccggtgctcgatttagtctgatcgagaagggaaagggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacaccgccatgaacaaggagtacttggcttggttccagcagaaagcagggcagccccctaagctgctcatttactcggcatccacccggaaatccggagttcctgaccgattccgtggcagcgggtctgggacagattttactctcaccatcagtagcctgcagactgaagatgtggcagtttattactgtcaacaatattttcatactccgccgacgttcggccgggggaccgaacgtggaaatcaaacgaactagtggctgcaccatct

SEQ ID NO: 590622 - DNA, 521 bp, Homo sapiens
  misc_feature: HIJSMM301B74KF.5.27.C05.1.454.light.4.raw
atcagacacgcacgaccggtgctcgatttagacgcgatcgaagggtttggggagtctgggcctaaggaagcagcactggtggtgcctcagccatggcctggaacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaacccactgtcactctgttcccaccctcctccgtcg

SEQ ID NO: 590623 - DNA, 479 bp, Homo sapiens; identical to SEQ ID NO: 548833
  misc_feature: HIJSMM301BIM8H.16.86.H09.1.454.light.4.raw

SEQ ID NO: 590624 - DNA, 490 bp, Homo sapiens
  misc_feature: HIJSMM301BNH0M.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtcttggtttggaagtggggtcccatcaaggttcagtggcgccggatctgggacagaattcactctcaccatcagcgggctccagtctgaggactctgcaacttattactgccaacaatatgatatttattctccagcgttcggccagggaccaaggtggaagtcgaagcgaactgtaggctgcaccatctgtt

SEQ ID NO: 590625 - DNA, 497 bp, Homo sapiens; identical to SEQ ID NO: 545672
  misc_feature: HIJSMM301DOGIR.2.49.E05.1.454.light.4.raw

SEQ ID NO: 590626 - DNA, 494 bp, Homo sapiens; identical to SEQ ID NO: 587470
  misc_feature: HIJSMM301AR49R.52.86.H09.1.454.light.4.raw

SEQ ID NO: 590627 - DNA, 512 bp, Homo sapiens; identical to SEQ ID NO: 541300
  misc_feature: HIJSMM301B4RYS.17.33.C11.1.454.light.4.raw

SEQ ID NO: 590628 - DNA, 486 bp, Homo sapiens; identical to SEQ ID NO: 537617
  misc_feature: HIJSMM301B92D0.10.53.E09.1.454.light.4.raw

SEQ ID NO: 590629 - DNA, 485 bp, Homo sapiens; identical to SEQ ID NO: 538053
  misc_feature: HIJSMM301BV7IN.13.5.A05.1.454.light.4.raw

SEQ ID NO: 590630 - DNA, 490 bp, Homo sapiens
  misc_feature: HIJSMM301C0KHC.12.12.B01.1.454.light.4.raw
atacgacgtacacgaccggtgctcgatttagtagtgtagattccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtccccaggacaaacggccaggatcacctgctctggagctgcattgccaataaatctccttattggtaccagcagaagtcaggccaggcccctgtattggtcatctatgaggacaacagacgaccttccgggatccctgagagattctctggctccacctcagggacaatggccaccttgactatcagtggcgcccaggtggaggatgaggctgactta

SEQ ID NO: 590631 - DNA, 493 bp, Homo sapiens
  misc_feature: HIJSMM301EP2KK.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattctactttcggccctggaccaaagtggatttcagacgaactgtggctgcaccatctgtcttcta

SEQ ID NO: 590632 - DNA, 459 bp, Homo sapiens
  misc_feature: HIJSMM301DHDK0.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtgttttcggcggagggccaagctgaccgtcctaggtcagcccaaggctgccccctcggtcactctgttcccaccctcctccgtatctctcg

SEQ ID NO: 590633 - DNA, 492 bp, Homo sapiens
  misc_feature: HIJSMM301ETAIX.41.67.G01.1.454.light.4.raw
tctatactatcacgaccggtgctcgatttagagtatacatattgggtttgggggagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacgggatccctgatcgcttctcaggctccagctctggggctgagcgctacctttcgatctccagcctccagtctgaggatgaggctgactattactgtcagtcctgggacaggggcgttttggtgttcggcggagggaccagactgaccgtcctgggtcagcccaaggctgccccctggt

SEQ ID NO: 590634 - DNA, 518 bp, Homo sapiens
  misc_feature: HIJSMM301DKX6H.13.55.E11.1.454.light.4.raw
  modified_base (509)..(509): a, c, t, g, unknown or other
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccccncctctagta

SEQ ID NO: 590635 - DNA, 487 bp, Homo sapiens
  misc_feature: HIJSMM301AFWTS.4.21.B10.1.454.light.4.raw
agcactgtagcacgaccggtgctcgatttagtgtcgtcgcaagaggagaggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttatactgtcagcagtattatataactcccttcactttcggcggagggaccaaggtcggagatcaaacgaa

SEQ ID NO: 590636 - DNA, 497 bp, Homo sapiens; identical to SEQ ID NO: 551301
  misc_feature: HIJSMM301EMASF.15.81.H04.1.454.light.4.raw

SEQ ID NO: 590637 - DNA, 501 bp, Homo sapiens
  misc_feature: HIJSMM301DSC56.40.42.D09.1.454.light.4.raw
  modified_base (239)..(239): a, c, t, g, unknown or other
tctagcgactcacgaccggtgctcgatttagacacatacgcagggaaagggggtgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattggtaccaacagaagtcaggccaggcccctgtgctggtcatctatgaggacaacaaacgaccctccgagatccctgagagattctctggctccagctcagggacaatggccaccttggctctcagtgggcccaggtggaggatgaagctgactactactgttactcagtggacagcaggtggaaatcatgggtattcggcggagggaccaagctgaccgtcctaggtcagcccaaggctcgccccctcggtcact

SEQ ID NO: 590638 - DNA, 492 bp, Homo sapiens
  misc_feature: HIJSMM301C30HZ.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgttcggccaagggaccaaggtggatatcagacgaactgtgg

SEQ ID NO: 590639 - DNA, 486 bp, Homo sapiens
  misc_feature: HIJSMM301BW5VB.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcccttaatcttcggccaagggacacgactggagattaaacgaactgtggctggcaccta

SEQ ID NO: 590640 - DNA, 488 bp, Homo sapiens
  misc_feature: HIJSMM301EFJFU.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccaggggccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggagatcaaacgaactgtggctgcaccat

SEQ ID NO: 590641 - DNA, 487 bp, Homo sapiens; identical to SEQ ID NO: 541187
  misc_feature: HIJSMM301D1TE0.43.36.D03.1.454.light.4.raw

SEQ ID NO: 590642 - DNA, 447 bp, Homo sapiens; identical to SEQ ID NO: 535201
  misc_feature: HIJSMM301EIZ7G.18.9.A09.1.454.light.4.raw

SEQ ID NO: 590643 - DNA, 504 bp, Homo sapiens
  misc_feature: HIJSMM301C3C3R.8.28.C06.1.454.light.4.raw
ctcgcgtgtccacgaccggtgctcgatttagagctcacgtattgggtttggggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtggctgcaccatctgtcttcatcttcccgccat

SEQ ID NO: 590644 - DNA, 494 bp, Homo sapiens; identical to SEQ ID NO: 537418
  misc_feature: HIJSMM301BBTSY.9.1.A01.1.454.light.4.raw

SEQ ID NO: 590645 - DNA, 446 bp, Homo sapiens
  misc_feature: HIJSMM301BRJPJ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 590646 - DNA, 520 bp, Homo sapiens
  misc_feature: HIJSMM301D1JT5.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtccactctcgttcccaccctcctccacg

SEQ ID NO: 590647 - DNA, 494 bp, Homo sapiens
  misc_feature: HIJSMM301B8KEX.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatt

SEQ ID NO: 590648 - DNA, 480 bp, Homo sapiens
  misc_feature: HIJSMM301AXESF.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgcctcaccttcggcgggggaccaaggtggagatacaaacgaactgtggctgcacc

SEQ ID NO: 590649 - DNA, 454 bp, Homo sapiens; identical to SEQ ID NO: 536347
  misc_feature: HIJSMM301DUEKI.19.86.H09.1.454.light.4.raw

SEQ ID NO: 590650 - DNA, 500 bp, Homo sapiens
  misc_feature: HIJSMM301AULMT.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttccccgccctcctccacgagagta

SEQ ID NO: 590651 - DNA, 515 bp, Homo sapiens
  misc_feature: HIJSMM301C36MC.43.12.B01.1.454.light.4.raw
tgtgagtagtcacgaccggtgctcgatttagtagtgtagattcgtggggctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagccaaggctgccccctcggtcactctgttcccgccctcctcacta

SEQ ID NO: 590652 - DNA, 520 bp, Homo sapiens
  misc_feature: HIJSMM301DPFLO.27.23.C01.1.454.light.4.raw
  modified_base (448)..(448): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtnttcggcggagggaccaggctgaccgtcctaggtcagcccaaggctgccccctggtcactctgttcccgcctt

SEQ ID NO: 590653 - DNA, 505 bp, Homo sapiens
  misc_feature: HIJSMM301ESC7W.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctgggtccctgatcgcttctctggttccatccttgggaacaaagctgccctcaccatcgcggggcccaggcagatgatgagtgtgattattactgtgtgctctatatgggcagtggcgtttgggtgttcggcggagggaccaagctgaccgttcg

SEQ ID NO: 590654 - DNA, 486 bp, Homo sapiens
  misc_feature: HIJSMM301A7KGI.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagttttattactgtcagcaatattatagtactcctccgaggctcactttcggcggagggaccaaggtggagatcaaacgaa

SEQ ID NO: 590655 - DNA, 484 bp, Homo sapiens; identical to SEQ ID NO: 535400
  misc_feature: HIJSMM301CJJOD.46.26.C04.1.454.light.4.raw

SEQ ID NO: 590656 - DNA, 484 bp, Homo sapiens; identical to SEQ ID NO: 535400
  misc_feature: HIJSMM301AZDW1.46.26.C04.1.454.light.4.raw

SEQ ID NO: 590657 - DNA, 487 bp, Homo sapiens; identical to SEQ ID NO: 536006
  misc_feature: HIJSMM301C145H.4.64.F09.1.454.light.4.raw

SEQ ID NO: 590658 - DNA, 502 bp, Homo sapiens
  misc_feature: HIJSMM301CA2FC.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtggacagcggcactgtggttttcggcggagggaccaagctgaccgtcctcggtcagcccaaggctgccccctcggtcactctgttcccgccctccc

SEQ ID NO: 590659 - DNA, 504 bp, Homo sapiens
  misc_feature: HIJSMM301A01BC.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcgtccaagggaccaaggtggaaatcaaacgaactagtggctgcaccatctgtcttctatcttccccg

SEQ ID NO: 590660 - DNA, 497 bp, Homo sapiens; identical to SEQ ID NO: 536371
  misc_feature: HIJSMM301A4QLK.16.78.H01.1.454.light.4.raw

SEQ ID NO: 590661 - DNA, 493 bp, Homo sapiens
  misc_feature: HIJSMM301CRM5P.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaacgac

SEQ ID NO: 590662 - DNA, 515 bp, Homo sapiens
  misc_feature: HIJSMM301AFZ38.51.38.D05.1.454.light.4.raw
cgatcgtatacacgaccggtgctcgatttagtatctgatagttgggtttgggtagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccgaaactagaccgtcctaggtcagcccaaggctgcccctccggtcactctgttcccgccctcctctcgtagcact

SEQ ID NO: 590663 - DNA, 516 bp, Homo sapiens
  misc_feature: HIJSMM301BSRD6.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcgggtggggcccaggtggaagatgaagctgactacttctgttactcaacagacgacagtgcggatcatagagggatgttcggcggagggaccaagctgaccgtcctaggtcagcccaaggctgccccctcggtcactctgttcccgcctcctc

SEQ ID NO: 590664 - DNA, 496 bp, Homo sapiens; identical to SEQ ID NO: 535109
  misc_feature: HIJSMM301CT63N.16.78.H01.1.454.light.4.raw

SEQ ID NO: 590665 - DNA, 493 bp, Homo sapiens; identical to SEQ ID NO: 558130
  misc_feature: HIJSMM301EEYYA.5.48.E04.1.454.light.4.raw

SEQ ID NO: 590666 - DNA, 494 bp, Homo sapiens; identical to SEQ ID NO: 540110
  misc_feature: HIJSMM301DRC7T.51.71.G05.1.454.light.4.raw

SEQ ID NO: 590667 - DNA, 483 bp, Homo sapiens
  misc_feature: HIJSMM301AEA5H.52.2.A02.1.454.light.4.raw
cgcagtacgacacgaccggtgctcgatttagactcatctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgtcaacatattactgtcaacagtatgataatctcccgcctctactttcggtcggagggaccgaacggtaggaggatcagaacggaactagtgg

SEQ ID NO: 590668 - DNA, 498 bp, Homo sapiens
  misc_feature: HIJSMM301ELG4A.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaatcagcagacagtagtggttcttattgggtgttcgggcgggaggaccaagctgaccgtccttggtcagcccaaggctcgccccctcggtcactctcg

SEQ ID NO: 590669 - DNA, 498 bp, Homo sapiens
  misc_feature: HIJSMM301D2UUU.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgtattttgcgacttactactgtcaacagagtttccggaaccccgttactttcggcggagggaccaaggtggagatcaaacgaactgtggctgcaccatctgtcttcatctcccg

SEQ ID NO: 590670 - DNA, 490 bp, Homo sapiens; identical to SEQ ID NO: 540941
  misc_feature: HIJSMM301C1N5J.16.72.G06.1.454.light.4.raw

SEQ ID NO: 590671 - DNA, 510 bp, Homo sapiens
  misc_feature: HIJSMM301AJZ7Y.48.59.F04.1.454.light.4.raw
agtatacatacacgaccggtgctcgatttagtacacacacttagggattgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatgggcccaggtggacgatgaggctgactactactgttcctcaacagacagtagtggtgatcgagggctggttcggcgggagggaccaagctgaccgtcctaagtcagcccaaggctcgccccctcggtcactctgttcccccg

SEQ ID NO: 590672 - DNA, 483 bp, Homo sapiens
  misc_feature: HIJSMM301BXPES.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcgacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgtt

SEQ ID NO: 590673 - DNA, 511 bp, Homo sapiens
  misc_feature: HIJSMM301A4VP8.40.53.E09.1.454.light.4.raw
tctagcgactcacgaccggtgctcgatttagagagagtgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggcccagcctccacgttcactcatcgtcagcacaagcagacgtttgcctggggtgcctgatcgcttctctgcctccatccttgggaacaaagctgccctcaccattacggggcccagccagaggatgagtcttattattactgcatgctccatgtggggggtgccacttgggtgttcggcggagggaccaagctgaccgtccg

SEQ ID NO: 590674 - DNA, 485 bp, Homo sapiens; identical to SEQ ID NO: 536576
  misc_feature: HIJSMM301DEIUH.46.35.D02.1.454.light.4.raw

SEQ ID NO: 590675 - DNA, 505 bp, Homo sapiens
  misc_feature: HIJSMM301CFIMA.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncgggcgttcggccaagggaccaaggtggaaatacaaacgaaactgtggctgcaccatctgtcttcatcttccccg

SEQ ID NO: 590676 - DNA, 490 bp, Homo sapiens
  misc_feature: HIJSMM301BERQK.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatccaccttcggccaagggacacgactggagattaacgaactagtggctgcaccatctgtcttcat

SEQ ID NO: 590677 - DNA, 497 bp, Homo sapiens; identical to SEQ ID NO: 535286
  misc_feature: HIJSMM301ED56L.18.59.F04.1.454.light.4.raw

SEQ ID NO: 590678 - DNA, 477 bp, Homo sapiens
  misc_feature: HIJSMM301BM6H1.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctcgggactgaagtgcatatgaagagaactgtggctgca

SEQ ID NO: 590679 - DNA, 493 bp, Homo sapiens
  misc_feature: HIJSMM301D1AKW.43.39.D06.1.454.light.4.raw
tgtgagtagtcacgaccggtgctcgatttagtgacatctcgcagttctttgggcacgaccagtgctcgatttagtgacatctcgcagttctttgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 590680 - DNA, 465 bp, Homo sapiens; identical to SEQ ID NO: 538589
  misc_feature: HIJSMM301BMT4T.12.39.D06.1.454.light.4.raw

SEQ ID NO: 590681 - DNA, 493 bp, Homo sapiens
  misc_feature: HIJSMM301DCJTC.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgtttcggcggagggaccaaggtggagatcaaacgaactgtggctgcaccatctgtcttcatcttcccgccat

SEQ ID NO: 590682 - DNA, 507 bp, Homo sapiens
  misc_feature: HIJSMM301D2XWA.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctcgccccctcggt

SEQ ID NO: 590683 - DNA, 434 bp, Homo sapiens; identical to SEQ ID NO: 535153
  misc_feature: HIJSMM301DALVC.18.5.A05.1.454.light.4.raw

SEQ ID NO: 590684 - DNA, 514 bp, Homo sapiens; identical to SEQ ID NO: 538541
  misc_feature: HIJSMM301AUS8G.47.23.C01.1.454.light.4.raw

SEQ ID NO: 590685 - DNA, 501 bp, Homo sapiens
  misc_feature: HIJSMM301D1RKE.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaacccatgtca

SEQ ID NO: 590686 - DNA, 505 bp, Homo sapiens; identical to SEQ ID NO: 588626
  misc_feature: HIJSMM301CYCA9.2.35.D02.1.454.light.4.raw

SEQ ID NO: 590687 - DNA, 501 bp, Homo sapiens; identical to SEQ ID NO: 544659
  misc_feature: HIJSMM301C4UMO.4.39.D06.1.454.light.4.raw

SEQ ID NO: 590688 - DNA, 485 bp, Homo sapiens; identical to SEQ ID NO: 582490
  misc_feature: HIJSMM301AU5JA.47.46.E02.1.454.light.4.raw

SEQ ID NO: 590689 - DNA, 489 bp, Homo sapiens; identical to SEQ ID NO: 535139
  misc_feature: HIJSMM301BKIRQ.14.55.E11.1.454.light.4.raw

SEQ ID NO: 590690 - DNA, 466 bp, Homo sapiens
  misc_feature: HIJSMM301EUIE9.43.71.G05.1.454.light.4.raw
tgtgagtagtcacgaccggtgctcgatttagtgtcgtcgcaagagagagggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgttcttcatcttcccgccatctgaactactcaca

SEQ ID NO: 590691 - DNA, 486 bp, Homo sapiens
  misc_feature: HIJSMM301DLAU3.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatccaaggttcagcggcagtaggtctgggacagagttcactctcactatcagcggcctgcagcctgaagattctgcaacttatactgtctccagtatgatgcttaccctcggactttcggccaagggaccaaggtaggaatacaacgaaactgtggctggcaccta

SEQ ID NO: 590692 - DNA, 387 bp, Homo sapiens
  misc_feature: HIJSMM301AK1L7.48.27.C05.1.454.light.4.raw
agtatacatacacgaccggtgctcgatttagacgcgatcgaagggtttgggggagctacaacaggcaggcaggggcagcaagatggtgttgcagacccaggtcttcatttctctgttgctctggatctctggtgccgtacggggacatcgtgatgaaccagtctccagacgtccctggctgtgtctcgtgggcgagagggccaccatctactgcaagtccagccagagttctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 590693 - DNA, 479 bp, Homo sapiens; identical to SEQ ID NO: 535118
  misc_feature: HIJSMM301D5S1Z.13.59.F04.1.454.light.4.raw

SEQ ID NO: 590694 - DNA, 557 bp, Homo sapiens
  misc_feature: HIJSMM301CZA79.18.78.H01.1.454.light.4.raw
  modified_base (436)..(436): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaacncgacactctctaagttcgttccggttaacgtacgggtaccggaaaccggtaacggtaccgtacccgtacggttacggtacgacccgaacccgaaccggaacccccaacccctacgttcgta

SEQ ID NO: 590695 - DNA, 506 bp, Homo sapiens; identical to SEQ ID NO: 545686
  misc_feature: HIJSMM301DLYHP.18.37.D04.1.454.light.4.raw

SEQ ID NO: 590696 - DNA, 501 bp, Homo sapiens; identical to SEQ ID NO: 535746
  misc_feature: HIJSMM301B30RD.18.11.A11.1.454.light.4.raw

SEQ ID NO: 590697 - DNA, 493 bp, Homo sapiens
  misc_feature: HIJSMM301BVZNY.43.9.A09.1.454.light.4.raw
tgtgagtagtcacgaccggtgctcgatttagcgagacgcgcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtggacgaaggtcaccgtcaaggtcacg

SEQ ID NO: 590698 - DNA, 447 bp, Homo sapiens; identical to SEQ ID NO: 535020
  misc_feature: HIJSMM301EG22S.18.9.A09.1.454.light.4.raw

SEQ ID NO: 590699 - DNA, 486 bp, Homo sapiens
  misc_feature: HIJSMM301CAL1R.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccaacggtggaaatacaaacgaactagtggctgcacca

SEQ ID NO: 590700 - DNA, 484 bp, Homo sapiens
  misc_feature: HIJSMM301DMCCV.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacatatgatattattctccagcgttcggccaggggaccaaggtggaagtcaagcgaactgtggctgcaccatct

SEQ ID NO: 590701 - DNA, 514 bp, Homo sapiens; identical to SEQ ID NO: 546238
  misc_feature: HIJSMM301A2QIG.47.85.H08.1.454.light.4.raw

SEQ ID NO: 590702 - DNA, 486 bp, Homo sapiens; identical to SEQ ID NO: 535043
  misc_feature: HIJSMM301DBFIT.46.35.D02.1.454.light.4.raw

SEQ ID NO: 590703 - DNA, 491 bp, Homo sapiens; identical to SEQ ID NO: 535294
  misc_feature: HIJSMM301DKFZU.16.68.G02.1.454.light.4.raw

SEQ ID NO: 590704 - DNA, 494 bp, Homo sapiens; identical to SEQ ID NO: 535276
  misc_feature: HIJSMM301DS5WQ.16.6.A06.1.454.light.4.raw

SEQ ID NO: 590705 - DNA, 509 bp, Homo sapiens; identical to SEQ ID NO: 535670
  misc_feature: HIJSMM301AHE4Z.47.23.C01.1.454.light.4.raw

SEQ ID NO: 590706 - DNA, 490 bp, Homo sapiens; identical to SEQ ID NO: 543909
  misc_feature: HIJSMM301EMUL5.14.55.E11.1.454.light.4.raw

SEQ ID NO: 590707 - DNA, 508 bp, Homo sapiens
  misc_feature: HIJSMM301C058B.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggcccgctcactttcggcggagggaccaaggtggagatcaaacgaaactgtggctgcaccatctgtt

SEQ ID NO: 590708 - DNA, 484 bp, Homo sapiens; identical to SEQ ID NO: 547458
  misc_feature: HIJSMM301AVN7W.15.1.A01.1.454.light.4.raw

SEQ ID NO: 590709 - DNA, 502 bp, Homo sapiens
  misc_feature: HIJSMM301CJRGW.49.30.C08.1.454.light.4.raw
agtcgagagacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcaggggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcttcg

SEQ ID NO: 590710 - DNA, 505 bp, Homo sapiens
  misc_feature: HIJSMM301BMZU5.40.41.D08.1.454.light.4.raw
tctagcgactcacgaccggtgctcgattagtcacgcgagaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctgcccccc

SEQ ID NO: 590711 - DNA, 478 bp, Homo sapiens
  misc_feature: HIJSMM301D76S0.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtcgcccccttcacccttcggccaaggggacaccgactggagattagaacg

SEQ ID NO: 590712 - DNA, 496 bp, Homo sapiens
  misc_feature: HIJSMM301AVRF3.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacactttggccagggggccaagctggagatcaaacgaactgtggctgcaccatctgtt

SEQ ID NO: 590713 - DNA, 502 bp, Homo sapiens
  misc_feature: HIJSMM301CZ7UX.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtcggtattcggcggagggacccacctgaccgtcttaggtcagcccaaggctgccccctcggtcta

SEQ ID NO: 590714 - DNA, 472 bp, Homo sapiens
  misc_feature: HIJSMM301B2127.52.9.A09.1.454.light.4.raw
  modified_base (470)..(470): a, c, t, g, unknown or other
cgcagtacgacacgaccggtgctcgatttagcgagacgcgcagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaagcccagggaaagcccctaaactcctgatctctgctgcatctagtttgcatactgaggtcccatccaggttcagtggcggtggatctgggacagatttcactctcaccatcagcagtctgcaacctgaagattttgcaacttactactgtcaacagggttacggaaccctgctcatcttcggcggagggaccaaggttggagatcaaacgaacngt

SEQ ID NO: 590715 - DNA, 493 bp, Homo sapiens; identical to SEQ ID NO: 537422
  misc_feature: HIJSMM301A5R03.9.34.D01.1.454.light.4.raw

SEQ ID NO: 590716 - DNA, 508 bp, Homo sapiens
  misc_feature: HIJSMM301B4XHG.11.57.F02.1.454.light.4.raw
cgagagataccacgaccggtgctcgatttagctcgatatagttgggtttgggggaggaactgctcagttaggacccagagggaaccacggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccagggaccaggtggaagtcaagcgaactgtggctgcaccatctgtcttcatcttcccgccat

SEQ ID NO: 590717 - DNA, 447 bp, Homo sapiens; identical to SEQ ID NO: 535201
  misc_feature: HIJSMM301BQUPC.18.9.A09.1.454.light.4.raw

SEQ ID NO: 590718 - DNA, 487 bp, Homo sapiens; identical to SEQ ID NO: 546877
  misc_feature: HIJSMM301AHBIC.41.44.D11.1.454.light.4.raw

SEQ ID NO: 590719 - DNA, 441 bp, Homo sapiens; identical to SEQ ID NO: 534971
  misc_feature: HIJSMM301BJ1YB.11.3.A03.1.454.light.4.raw

SEQ ID NO: 590720 - DNA, 501 bp, Homo sapiens; identical to SEQ ID NO: 536867
  misc_feature: HIJSMM301ETREH.5.86.H09.1.454.light.4.raw

SEQ ID NO: 590721 - DNA, 492 bp, Homo sapiens
  misc_feature: HIJSMM301EOYXK.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacaatcagtggtacttatgtcttcggaactgggaccaaggtcaccgtcctaggtcagccaaggccaacccactgtcactctcg

SEQ ID NO: 590722 - DNA, 505 bp, Homo sapiens
  misc_feature: HIJSMM301CIFVQ.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggccccaaaattggtcatctatgaagacgacaaacgaccctccgggatccctgagagattctctggctccagctcagggactatggccaccttgactatcagtggggcccgaagtggaggatgaagctgactactactgttactcaatagagaacagtgataatttctgggtgttcggcggagggaccgaaactgaccgtcctaggtcagcccaaggctgccccctcggtcactctgtt

SEQ ID NO: 590723 - DNA, 516 bp, Homo sapiens
  misc_feature: HIJSMM301CNSZR.5.59.F04.1.454.light.4.raw
atcagacacgcacgaccggtgctcgatttagtacacacacttagggattgggggagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcgaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccgaagggaccgaaggtaggaaagtacaaacgaaactacgtggctgcaccactctgtcttctactcttcccgtcccta

SEQ ID NO: 590724 - DNA, 514 bp, Homo sapiens
  misc_feature: HIJSMM301A9WT9.7.34.D01.1.454.light.4.raw
cgtgtctctacacgaccggtgctcgatttagatcgtctgtggttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgacccatctctggactccagactgaggacgaggctgattattactgctgctcatatacaggggacagcattatttgggtgttcggcggagggaccaagctgaccgtcctgcgtcagcccaaggctgccccctcggtccact

SEQ ID NO: 590725 - DNA, 482 bp, Homo sapiens
  misc_feature: HIJSMM301DA7RW.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtacagttttggccaggggaccaagctggagatacaaacgaa

SEQ ID NO: 590726 - DNA, 484 bp, Homo sapiens
  misc_feature: HIJSMM301CKNQZ.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtgaggctgaggatgttgggtttatactgcatgcaagttctacaaacttcctacacttttggccaggggaccaagctggagatcaaacgaa

SEQ ID NO: 590727 - DNA, 494 bp, Homo sapiens; identical to SEQ ID NO: 534992
  misc_feature: HIJSMM301BTXFL.9.1.A01.1.454.light.4.raw

SEQ ID NO: 590728 - DNA, 507 bp, Homo sapiens
  misc_feature: HIJSMM301AV64Q.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacggggcccaggcagatgatgaatctaattatcactgtgcgttgtatatgggttttgctatttcggtgttcggcggagggacccaggtgaccgtcctacgtcagccc

SEQ ID NO: 590729 - DNA, 521 bp, Homo sapiens; identical to SEQ ID NO: 538715
  misc_feature: HIJSMM301AD8U0.27.23.C01.1.454.light.4.raw

SEQ ID NO: 590730 - DNA, 486 bp, Homo sapiens; identical to SEQ ID NO: 535043
  misc_feature: HIJSMM301B3EKM.46.35.D02.1.454.light.4.raw

SEQ ID NO: 590731 - DNA, 504 bp, Homo sapiens
  misc_feature: HIJSMM301CFXE6.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacncaacatgggatgacaatctgagcggttgggtgttcggcggagggaccaaactgaccgtcctaggtcagccccaa

SEQ ID NO: 590732 - DNA, 485 bp, Homo sapiens
  misc_feature: HIJSMM301EBXBR.10.53.E09.1.454.light.4.raw
catagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatcctacccgggaactccggggtccctgaccgattcagtggcagcgggtctgggacagatttcactctcaccatcagcagcctgcaggctgaagatgcggcagtttattactgtcagcactattatacgtaccccattcacattcggccctgggaccaaagtggaagatcaaacgaa

SEQ ID NO: 590733 - DNA, 522 bp, Homo sapiens; identical to SEQ ID NO: 568215
  misc_feature: HIJSMM301CSZVL.27.23.C01.1.454.light.4.raw

SEQ ID NO: 590734 - DNA, 494 bp, Homo sapiens; identical to SEQ ID NO: 535828
  misc_feature: HIJSMM301DZIT2.3.36.D03.1.454.light.4.raw

SEQ ID NO: 590735 - DNA, 500 bp, Homo sapiens
  misc_feature: HIJSMM301ARCEU.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactggaccgaaggtcaccgtcctaggtcagcccaacggccaaccca

SEQ ID NO: 590736 - DNA, 523 bp, Homo sapiens
  misc_feature: HIJSMM301CDFH7.9.25.C03.1.454.light.4.raw
tgatacgtctcacgaccggtgctcgatttagtagtgtagatttgggtttgggaacctatgaacattctgtaggggccactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtaggtgggggaatcgttcgggcggagggaccgaggctgaccgtcctaagtcagcccaaggctcgcccccgtcggtcta

SEQ ID NO: 590737 - DNA, 419 bp, Homo sapiens
  misc_feature: HIJSMM301EMZ7H.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccccactgtcactctcgttcccgccctcctccatactcgta

SEQ ID NO: 590738 - DNA, 499 bp, Homo sapiens; identical to SEQ ID NO: 571660
  misc_feature: HIJSMM301ERS9W.52.37.D04.1.454.light.4.raw

SEQ ID NO: 590739 - DNA, 490 bp, Homo sapiens
  misc_feature: HIJSMM301EXM25.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtaggagatacaaacgaaa

SEQ ID NO: 590740 - DNA, 486 bp, Homo sapiens; identical to SEQ ID NO: 537310
  misc_feature: HIJSMM301C3ILH.15.28.C06.1.454.light.4.raw

SEQ ID NO: 590741 - DNA, 516 bp, Homo sapiens
  misc_feature: HIJSMM301C7J2U.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcttcggccaacgggaacgaacggtaggaaagtacaaacgaactacgttggctggcaccaactctgtcttctactcttcccccg

SEQ ID NO: 590742 - DNA, 453 bp, Homo sapiens
  misc_feature: HIJSMM301A9PMS.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacggagta

SEQ ID NO: 590743 - DNA, 495 bp, Homo sapiens; identical to SEQ ID NO: 554164
  misc_feature: HIJSMM301DD02B.27.78.H01.1.454.light.4.raw

SEQ ID NO: 590744 - DNA, 505 bp, Homo sapiens
  misc_feature: HIJSMM301BQH0Q.43.21.B10.1.454.light.4.raw
tgtgagtagtcacgaccggtgctcgattttagtgtcgtcgcaacgacgagagggggaagaagctgctcagttaggacccgagaggggaaccaagtggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttca

SEQ ID NO: 590745 - DNA, 485 bp, Homo sapiens; identical to SEQ ID NO: 539576
  misc_feature: HIJSMM301B0MXT.4.57.F02.1.454.light.4.raw

SEQ ID NO: 590746 - DNA, 518 bp, Homo sapiens; identical to SEQ ID NO: 539372
  misc_feature: HIJSMM301BK382.7.86.H09.1.454.light.4.raw

SEQ ID NO: 590747 - DNA, 460 bp, Homo sapiens; identical to SEQ ID NO: 537107
  misc_feature: HIJSMM301C633E.22.28.C06.1.454.light.4.raw

SEQ ID NO: 590748 - DNA, 503 bp, Homo sapiens
  misc_feature: HIJSMM301EFN3F.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatacgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccaccct

SEQ ID NO: 590749 - DNA, 507 bp, Homo sapiens
  misc_feature: HIJSMM301C75HN.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatgtgtcactcgtcggccctcagagtctctcatcgctctcaggctccaagtctgcaacacggcctcctaaccatctctgggctccagtttgaggacgagtctacttattactgcagttcctttaaattaggcgccactctcgtggttttcggcggaggcaccgaagtgaccgtcctcggtcagcccaaggctgccccctcggtcact

SEQ ID NO: 590750 - DNA, 495 bp, Homo sapiens
  misc_feature: HIJSMM301EQXDU.51.83.H06.1.454.light.4.raw
cgatcgtatacacgaccggtgctcgatttagatcacgtgcgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactagtggctgcaccatctgtcttcat

SEQ ID NO: 590751 - DNA, 485 bp, Homo sapiens; identical to SEQ ID NO: 539315
  misc_feature: HIJSMM301AFJCJ.3.88.H11.1.454.light.4.raw

SEQ ID NO: 590752 - DNA, 484 bp, Homo sapiens; identical to SEQ ID NO: 535441
  misc_feature: HIJSMM301C9EYS.26.60.F05.1.454.light.4.raw

SEQ ID NO: 590753 - DNA, 517 bp, Homo sapiens
  misc_feature: HIJSMM301A8XGP.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctggtcagcccaaggctgccccctcggtcactctgttcccgccct

SEQ ID NO: 590754 - DNA, 514 bp, Homo sapiens
  misc_feature: HIJSMM301C6C7L.48.14.B03.1.454.light.4.raw
agtatacatacacgaccggtgctcgatttagtgtgagtagttccgcggggcgggtgggggcacttctccctctaacactctcccctgttgaagctctttgtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcaggttgaggctgaggatgttggcacttattactgcatgcaaggctcacactggcctccgtggacgttcggtccaggaaccc

SEQ ID NO: 590755 - DNA, 499 bp, Homo sapiens
  misc_feature: HIJSMM301ERJPC.16.46.E02.1.454.light.4.raw
  modified_base (465)..(465): a, c, t, g, unknown or other
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaagtcaccgtcctaggtcagcccaaggccaaccccaccngtcactctgttcccaccctcctccgagtagtaca

SEQ ID NO: 590756 - DNA, 493 bp, Homo sapiens
  misc_feature: HIJSMM301EXTD1.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccact

SEQ ID NO: 590757 - DNA, 518 bp, Homo sapiens
  misc_feature: HIJSMM301D2GZ9.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactcgtcactctcg

SEQ ID NO: 590758 - DNA, 519 bp, Homo sapiens
  misc_feature: HIJSMM301CX6DY.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcggggggaccaaggtgaccgtcctaagtcagcccaaggctgccccctcggtcactctgttcccaccctcctc

SEQ ID NO: 590759 - DNA, 487 bp, Homo sapiens
  misc_feature: HIJSMM301A0G8X.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaaacttcctacacttttggcaggggaccaagctggagatcaaacgaa

SEQ ID NO: 590760 - DNA, 492 bp, Homo sapiens
  misc_feature: HIJSMM301DD2XR.52.86.H09.1.454.light.4.raw
cgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagccaaggcaacccctctgt

SEQ ID NO: 590761 - DNA, 500 bp, Homo sapiens; identical to SEQ ID NO: 545976
  misc_feature: HIJSMM301C9UVD.14.23.C01.1.454.light.4.raw

SEQ ID NO: 590762 - DNA, 470 bp, Homo sapiens; identical to SEQ ID NO: 535302
  misc_feature: HIJSMM301BNQJY.13.76.G10.1.454.light.4.raw

SEQ ID NO: 590763 - DNA, 490 bp, Homo sapiens; identical to SEQ ID NO: 535234
  misc_feature: HIJSMM301BEN7R.17.21.B10.1.454.light.4.raw

SEQ ID NO: 590764 - DNA, 505 bp, Homo sapiens; identical to SEQ ID NO: 535503
  misc_feature: HIJSMM301E4DSM.8.28.C06.1.454.light.4.raw

SEQ ID NO: 590765 - DNA, 511 bp, Homo sapiens; identical to SEQ ID NO: 537464
  misc_feature: HIJSMM301AO1Z2.7.34.D01.1.454.light.4.raw

SEQ ID NO: 590766 - DNA, 484 bp, Homo sapiens; identical to SEQ ID NO: 537878
  misc_feature: HIJSMM301B92AE.17.34.D01.1.454.light.4.raw

SEQ ID NO: 590767 - DNA, 486 bp, Homo sapiens; identical to SEQ ID NO: 535917
  misc_feature: HIJSMM301BMWRW.3.10.A10.1.454.light.4.raw

SEQ ID NO: 590768 - DNA, 492 bp, Homo sapiens
  misc_feature: HIJSMM301CRSX4.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggcctcggacgttcgccgaaggaccaaggtggaagtcgaaacgaactgtggctgcaccatctgtctt

SEQ ID NO: 590769 - DNA, 489 bp, Homo sapiens; identical to SEQ ID NO: 541346
  misc_feature: HIJSMM301BRJSR.13.87.H10.1.454.light.4.raw

SEQ ID NO: 590770 - DNA, 486 bp, Homo sapiens
  misc_feature: HIJSMM301ETRDC.49.7.A07.1.454.light.4.raw
agtcgagagacacgaccggtgctcgatttagcacgtgtcgcaggggccttcaggccataatgagcgtctctgttttcagggtctctctcccagcctgtggtgactcaatcatcctctgcctctgcttccctgggatcctcggtcaagctcacctgcactctgagcagtgggcacagtacctacatcatcgcatggcataccagcagccagggaaggcccctcggtacttgatgaagcttgaacgtagtggaagcaacaacagtggggggcggagttcctgatcgcttctcaggctccagttctgggcctgacttctacctcaccatctccagcctccagtctgaggatgaggctgattattactgtgagacctgggacagtaacactcatactccctcattcggcggagggaccaagctgaccgtcctaggtcagcccaaggctgccccctggtcactctgttccccaccctcctctctctcgact

SEQ ID NO: 590771 - DNA, 474 bp, Homo sapiens; identical to SEQ ID NO: 538184
  misc_feature: HIJSMM301EPSJ0.13.76.G10.1.454.light.4.raw

SEQ ID NO: 590772 - DNA, 485 bp, Homo sapiens
  misc_feature: HIJSMM301EOIRU.52.3.A03.1.454.light.4.raw
cgcagtacgacacgaccggtgctcgatttagagagcgtcacagggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtccctcaaggttcagcggcagtggatctgggacagacttcactctcaccatcagcagcctgcagcctgatgactttgcaagttattattgccaacagtataacagtttttcattcacttttggccctgggacgacagtggatatcaaacgactgtggctgcaccatctgtcttcta

SEQ ID NO: 590773 - DNA, 509 bp, Homo sapiens; identical to SEQ ID NO: 585193
  misc_feature: HIJSMM301ATFQR.8.33.C11.1.454.light.4.raw

SEQ ID NO: 590774 - DNA, 480 bp, Homo sapiens; identical to SEQ ID NO: 535291
  misc_feature: HIJSMM301AKPLU.22.59.F04.1.454.light.4.raw

SEQ ID NO: 590775 - DNA, 441 bp, Homo sapiens; identical to SEQ ID NO: 534971
  misc_feature: HIJSMM301CPCN8.11.3.A03.1.454.light.4.raw

SEQ ID NO: 590776 - DNA, 503 bp, Homo sapiens; identical to SEQ ID NO: 559148
  misc_feature: HIJSMM301C2SRR.7.31.C09.1.454.light.4.raw

SEQ ID NO: 590777 - DNA, 497 bp, Homo sapiens; identical to SEQ ID NO: 536371
  misc_feature: HIJSMM301DLX70.16.78.H01.1.454.light.4.raw

SEQ ID NO: 590778 - DNA, 487 bp, Homo sapiens; identical to SEQ ID NO: 535583
  misc_feature: HIJSMM301AR5PM.22.73.G07.1.454.light.4.raw

SEQ ID NO: 590779 - DNA, 506 bp, Homo sapiens; identical to SEQ ID NO: 554189
  misc_feature: HIJSMM301CO9M3.19.78.H01.1.454.light.4.raw

SEQ ID NO: 590780 - DNA, 480 bp, Homo sapiens
  misc_feature: HIJSMM301D3QUR.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattaactggactccaggctgacgacgaagctgattattactgctcagcatgggacacggcctcagtgcgtgggttttcggcggagggaccgaagctgaccgtcctaggtcag

SEQ ID NO: 590781 - DNA, 496 bp, Homo sapiens
  misc_feature: HIJSMM301D6GMD.51.80.H03.1.454.light.4.raw
  modified_base (423)..(423): a, c, t, g, unknown or other
cgatcgtatacacgaccggtgctcgatttagctgtgcgtcgaagggaaagggctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtntgctattcggcggagggaccaagctgaccgtcctaggtcagcccaaggctgccccctggtcactctgttccca

SEQ ID NO: 590782 - DNA, 516 bp, Homo sapiens
  misc_feature: HIJSMM301C6KY6.52.46.E02.1.454.light.4.raw
cgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctcccctgaccatctctgggctccaggctgaggacgaggctgattattactgcagctcatatacaaacagaaacaacttgggtgttcggtcggcgggaccgagactgaccgtcctacgtcagcccaacggctgccccctccggtcgta

SEQ ID NO: 590783 - DNA, 497 bp, Homo sapiens; identical to SEQ ID NO: 546781
  misc_feature: HIJSMM301DN0B2.43.28.C06.1.454.light.4.raw

SEQ ID NO: 590784 - DNA, 490 bp, Homo sapiens; identical to SEQ ID NO: 538866
  misc_feature: HIJSMM301AJ5K1.40.81.H04.1.454.light.4.raw

SEQ ID NO: 590785 - DNA, 518 bp, Homo sapiens
  misc_feature: HIJSMM301BML51.17.1.A01.1.454.light.4.raw
cgtagactagcacgaccggtgctcgatttagacgtctcatcaaggaaggaggaacagaaagagaggagtcccttccaatatcagtaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaaagcccccaggacactgatttatgatacaaacaacaaacactcctggacccctgcccggttctcaggctccctcgttggggcaaagctgccctgaccctttcgggtgcgcagcctgaggatgaggctgagtattactgcctactctactttggtggtgctgtgctattcggcggagggaccaagctgaccgtcttaagtcagcccaaggctgccccctcggtcactctgttcccaccctcct

SEQ ID NO: 590786 - DNA, 504 bp, Homo sapiens; identical to SEQ ID NO: 536385
  misc_feature: HIJSMM301CQ6N1.27.78.H01.1.454.light.4.raw

SEQ ID NO: 590787 - DNA, 496 bp, Homo sapiens
  misc_feature: HIJSMM301EM3JP.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaaacagacaccattggtacttatgtcttcggaactgcgaccaaggtcaccgtcctgggtcagcccaaggccaacccactgtcact

SEQ ID NO: 590788 - DNA, 519 bp, Homo sapiens
  misc_feature: HIJSMM301APXDN.13.55.E11.1.454.light.4.raw
tcacgtactacacgaccggtgctcgatttagcactcgcacgttggggtttggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggccaaccccactgtcactctgttccccg

SEQ ID NO: 590789 - DNA, 493 bp, Homo sapiens; identical to SEQ ID NO: 538283
  misc_feature: HIJSMM301ENR9A.10.79.H02.1.454.light.4.raw

SEQ ID NO: 590790 - DNA, 474 bp, Homo sapiens; identical to SEQ ID NO: 561309
  misc_feature: HIJSMM301A9W6H.5.12.B01.1.454.light.4.raw

SEQ ID NO: 590791 - DNA, 485 bp, Homo sapiens; identical to SEQ ID NO: 538053
  misc_feature: HIJSMM301CD0NN.13.5.A05.1.454.light.4.raw

SEQ ID NO: 590792 - DNA, 500 bp, Homo sapiens; identical to SEQ ID NO: 539795
  misc_feature: HIJSMM301B9F5U.22.38.D05.1.454.light.4.raw

SEQ ID NO: 590793 - DNA, 484 bp, Homo sapiens
  misc_feature: HIJSMM301B2BX3.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttatactgtcagcactattatagtaccccattcacattcggccctgggaccaagtggagatcaaacgaa

SEQ ID NO: 590794 - DNA, 487 bp, Homo sapiens
  misc_feature: HIJSMM301CSDKA.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaccagggacagccctaaactcctgatttttaagacatctgatttagaaagtggggtccatcaaggttcagcggcagtgggtctgggacagaattcactctcaccatcagcagcctgcaacctgatgactttgctaacttattactgccaacagtataatggttatgaatccactttggccaagggaccaagctggagatcaaacgaactgtggctgcaccta

SEQ ID NO: 590795 - DNA, 510 bp, Homo sapiens
  misc_feature: HIJSMM301DCWWM.51.49.E05.1.454.light.4.raw
cgatcgtatacacgaccggtgctcgatttagagcgactagcaacacacaagggggtgggctcagaagcagagttctggggtgtctccaccatggcctggacccctctctggctcactctcctcactctttgcataggttctgtggtttcctctgagctgactcaggaccccgctgtatctgtggccttgggacagacagtcaggatcacatgccaaggagacagcctcacaagttattatgcaggctggtaccagcagaagccaggacaagcccctatacttgtcctctatggtaataatcaccggccctcagggatcccagaccgattctctggctccagctcaggaaacacagcttccttgaccatcactggggctcaggcggaagatgaggctgactactactgtaattcccgggacaccagtggtcatagtggaaaccgggtcgtgttcggcggagggaccaaggtgaccgtcctgggtcagcccaaggctgccccctcggtctac

SEQ ID NO: 590796 - DNA, 498 bp, Homo sapiens
  misc_feature: HIJSMM301B15Z0.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaatacaaacgaactgtggctgca

SEQ ID NO: 590797 - DNA, 515 bp, Homo sapiens
  misc_feature: HIJSMM301C9ZKF.51.41.D08.1.454.light.4.raw
cgatcgtatacacgaccggtgctcgatttagtcacgcgagaaagggaaagggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtgggggatgagggtgattactactgttactcaacagacattactactactcatagggtgttcggcggagggaccaagctgaccgtcctaggtcagcccaaggctgccccctcggtcactctgttcccgccct

SEQ ID NO: 590798 - DNA, 490 bp, Homo sapiens; identical to SEQ ID NO: 536746
  misc_feature: HIJSMM301BG8TM.17.21.B10.1.454.light.4.raw

SEQ ID NO: 590799 - DNA, 503 bp, Homo sapiens; identical to SEQ ID NO: 584771
  misc_feature: HIJSMM301D76VP.4.39.D06.1.454.light.4.raw

SEQ ID NO: 590800 - DNA, 504 bp, Homo sapiens
  misc_feature: HIJSMM301BIPRA.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaaggaccaaggtggagatacaaacgaactgtggctgcaccatctgtcttcatcttccgccat

SEQ ID NO: 590801 - DNA, 482 bp, Homo sapiens
  misc_feature: HIJSMM301AQK5H.43.12.B01.1.454.light.4.raw
tgtgagtagtcacgaccggtgctcgatttagtagtgtagattccgcgggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccttaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcaccatc

SEQ ID NO: 590802 - DNA, 494 bp, Homo sapiens; identical to SEQ ID NO: 537883
  misc_feature: HIJSMM301AMBNK.15.58.F03.1.454.light.4.raw

SEQ ID NO: 590803 - DNA, 490 bp, Homo sapiens
  misc_feature: HIJSMM301CB7U7.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggctgggacaccaacactgtggttttcggcggagggaccaagctgaccgtccaggtcagccaaggctgccccctcggtca

SEQ ID NO: 590804 - DNA, 514 bp, Homo sapiens; identical to SEQ ID NO: 543100
  misc_feature: HIJSMM301ERH6Z.8.23.C01.1.454.light.4.raw

SEQ ID NO: 590805 - DNA, 504 bp, Homo sapiens
  misc_feature: HIJSMM301AFQS1.48.36.D03.1.454.light.4.raw
  modified_base (403)..(403): a, c, t, g, unknown or other
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatnaggctgattattactgctgttcattttcaagttcctttttgtcttcggaactgggaccgaggtcacctcctaggtcagcccaaggccaaccccactgtcta

SEQ ID NO: 590806 - DNA, 518 bp, Homo sapiens; identical to SEQ ID NO: 539372
  misc_feature: HIJSMM301AJ0IS.7.86.H09.1.454.light.4.raw

SEQ ID NO: 590807 - DNA, 522 bp, Homo sapiens
  misc_feature: HIJSMM301EMNCE.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgtcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 590808 - DNA, 513 bp, Homo sapiens
  misc_feature: HIJSMM301B9R1U.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagttttcagttgtccccccggacgttcggccgacgggaccgaccagtagaaatagagacgaactagtggctgcaccactctgtcttctactcttcccgt

SEQ ID NO: 590809 - DNA, 505 bp, Homo sapiens; identical to SEQ ID NO: 546412
  misc_feature: HIJSMM301AZIBM.22.21.B10.1.454.light.4.raw

SEQ ID NO: 590810 - DNA, 494 bp, Homo sapiens; identical to SEQ ID NO: 543247
  misc_feature: HIJSMM301DJCHI.22.57.F02.1.454.light.4.raw

SEQ ID NO: 590811 - DNA, 506 bp, Homo sapiens; identical to SEQ ID NO: 544872
  misc_feature: HIJSMM301CPK2B.18.78.H01.1.454.light.4.raw

SEQ ID NO: 590812 - DNA, 509 bp, Homo sapiens
  misc_feature: HIJSMM301AIGAQ.12.48.E04.1.454.light.4.raw
atacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggcccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtggttcggcggagggaccaagctgaccgtcctaggtcagcccaaggcagccccctcggtcactc

SEQ ID NO: 590813 - DNA, 490 bp, Homo sapiens
  misc_feature: HIJSMM301AQMQX.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttggccaagggaccaaggtggaatcagacgaactggtggctgcaccatctgtcttcta

SEQ ID NO: 590814 - DNA, 484 bp, Homo sapiens
  misc_feature: HIJSMM301AN54R.48.37.D04.1.454.light.4.raw
agtatacatacacgaccggtgctcgatttagtagcatactgttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 590815 - DNA, 505 bp, Homo sapiens
  misc_feature: HIJSMM301BQO5Z.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttccaccctcaccatcaatagcctggaagctgaagatgctgcaacttattactgtcatcagagtactactttacctcaagtgatcaccttcggccaagggacacgactggagattaaacg

SEQ ID NO: 590816 - DNA, 493 bp, Homo sapiens
  misc_feature: HIJSMM301DFHZ9.4.72.G06.1.454.light.4.raw
agcactgtagcacgaccggtgctcgatttagctacgactgcaagggaaagggggaggaactgctcagttaggacccaggcggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccaacgggaccgaacggtaggaaagtacaaacgaactagtggctgcaccat

SEQ ID NO: 590817 - DNA, 502 bp, Homo sapiens
  misc_feature: HIJSMM301AUA22.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatccccagcccaggttcagtggcagtgggtctggggacagagttcactctcaccatcagcagcctgcagtctgaagatttttgcggtttattactgtcagcagtataataactggcctccacggtacactttttggccaggggaccaagctggagatcaaacgaactgtggctgcaccatctgtt

SEQ ID NO: 590818 - DNA, 473 bp, Homo sapiens
  misc_feature: HIJSMM301DR6KL.51.28.C06.1.454.light.4.raw
cgatcgtatacacgaccggtgctcgatttagagctcacgtattgggtttggggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccgaaggtggaggatcaagcgaa

SEQ ID NO: 590819 - DNA, 506 bp, Homo sapiens; identical to SEQ ID NO: 548581
  misc_feature: HIJSMM301EGXW0.11.75.G09.1.454.light.4.raw

SEQ ID NO: 590820 - DNA, 458 bp, Homo sapiens
  misc_feature: HIJSMM301DOL6Z.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctggtcactctgttcccaccctctcacgcgtatgt

SEQ ID NO: 590821 - DNA, 484 bp, Homo sapiens; identical to SEQ ID NO: 535400
  misc_feature: HIJSMM301BEIL7.46.26.C04.1.454.light.4.raw

SEQ ID NO: 590822 - DNA, 493 bp, Homo sapiens; identical to SEQ ID NO: 536246
  misc_feature: HIJSMM301EUSOX.49.66.F11.1.454.light.4.raw

SEQ ID NO: 590823 - DNA, 480 bp, Homo sapiens
  misc_feature: HIJSMM301DKGM5.48.38.D05.1.454.light.4.raw
agtatacatacacgaccggtgctcgatttagtatctgatagttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccagggctatggatgaggctgactattactgtcaggcgtgggacatcagcagtgaggtggttttcggcggagggaccaagctgaccgtcctaagtcagcccaac

SEQ ID NO: 590824 - DNA, 506 bp, Homo sapiens
  misc_feature: HIJSMM301AKYVX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaagggaccaaggtggaaatacaaacgaaactgtggctgcaccatctgtcttcatcttccccg

SEQ ID NO: 590825 - DNA, 475 bp, Homo sapiens
  misc_feature: HIJSMM301AE6AA.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagatttgcaacttactattgtcaacaggctgacagtctcccgctcactttcggcggagggaccaaggtggagatcaaacgaactgtggctgca

SEQ ID NO: 590826 - DNA, 503 bp, Homo sapiens; identical to SEQ ID NO: 553138
  misc_feature: HIJSMM301D2QVC.22.15.B04.1.454.light.4.raw

SEQ ID NO: 590827 - DNA, 521 bp, Homo sapiens; identical to SEQ ID NO: 538715
  misc_feature: HIJSMM301ETY4F.27.23.C01.1.454.light.4.raw

SEQ ID NO: 590828 - DNA, 503 bp, Homo sapiens
  misc_feature: HIJSMM301A06PV.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatggggatgacaatctgagcggttgggtgttcggcggaggaccaaactgaccgtcctaggtcagccctaa

SEQ ID NO: 590829 - DNA, 527 bp, Homo sapiens
  misc_feature: HIJSMM301A4V3E.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttccccctcctttaccg

SEQ ID NO: 590830 - DNA, 510 bp, Homo sapiens
  misc_feature: HIJSMM301EEW83.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctcggcgacgttcggccaagggaccaaggtggaagtcaagcgaactgtggctgcaccatctgtcttcatcttcccgccact

SEQ ID NO: 590831 - DNA, 484 bp, Homo sapiens; identical to SEQ ID NO: 535400
  misc_feature: HIJSMM301CMJ3C.46.26.C04.1.454.light.4.raw

SEQ ID NO: 590832 - DNA, 487 bp, Homo sapiens; identical to SEQ ID NO: 538190
  misc_feature: HIJSMM301AM23L.47.70.G04.1.454.light.4.raw

SEQ ID NO: 590833 - DNA, 479 bp, Homo sapiens; identical to SEQ ID NO: 540947
  misc_feature: HIJSMM301A61RG.52.1.A01.1.454.light.4.raw

SEQ ID NO: 590834 - DNA, 465 bp, Homo sapiens
  misc_feature: HIJSMM301B22UW.15.83.H06.1.454.light.4.raw
  modified_base (459)..(459): a, c, t, g, unknown or other
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagttcagtatccccggaccgtgtcacgacgacgagacgagactanaacgac

SEQ ID NO: 590835 - DNA, 508 bp, Homo sapiens
  misc_feature: HIJSMM301CTDOC.48.27.C05.1.454.light.4.raw
  modified_base (236)..(236): a, c, t, g, unknown or other
agtatacatacacgaccggtgctcgatttagacgcgatcgaagggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgttccccg

SEQ ID NO: 590836 - DNA, 497 bp, Homo sapiens
  misc_feature: HIJSMM301A5ZQX.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtacttttggccaggggaccaagctggagatacaaacgaactgtggctgcaccatctgtctt

SEQ ID NO: 590837 - DNA, 498 bp, Homo sapiens
  misc_feature: HIJSMM301E2Y2N.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaaggctgaccgtcctgagtcagcccaaggctgccccctccgggtcact

SEQ ID NO: 590838 - DNA, 470 bp, Homo sapiens
  misc_feature: HIJSMM301BHBU7.49.37.D04.1.454.light.4.raw
agtcgagagacacgaccggtgctcgatttagtagcatactgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtgg

SEQ ID NO: 590839 - DNA, 494 bp, Homo sapiens; identical to SEQ ID NO: 535276
  misc_feature: HIJSMM301EJRXQ.16.6.A06.1.454.light.4.raw

SEQ ID NO: 590840 - DNA, 494 bp, Homo sapiens; identical to SEQ ID NO: 534992
  misc_feature: HIJSMM301BN788.9.1.A01.1.454.light.4.raw

SEQ ID NO: 590841 - DNA, 488 bp, Homo sapiens; identical to SEQ ID NO: 542699
  misc_feature: HIJSMM301CZ4SG.12.51.E07.1.454.light.4.raw

SEQ ID NO: 590842 - DNA, 495 bp, Homo sapiens; identical to SEQ ID NO: 535007
  misc_feature: HIJSMM301BO5CM.22.5.A05.1.454.light.4.raw

SEQ ID NO: 590843 - DNA, 505 bp, Homo sapiens; identical to SEQ ID NO: 535503
  misc_feature: HIJSMM301A3D4Z.8.28.C06.1.454.light.4.raw

SEQ ID NO: 590844 - DNA, 493 bp, Homo sapiens; identical to SEQ ID NO: 535084
  misc_feature: HIJSMM301EVEOF.47.64.F09.1.454.light.4.raw

SEQ ID NO: 590845 - DNA, 460 bp, Homo sapiens; identical to SEQ ID NO: 536053
  misc_feature: HIJSMM301BR98F.22.28.C06.1.454.light.4.raw

SEQ ID NO: 590846 - DNA, 488 bp, Homo sapiens
  misc_feature: HIJSMM301DKTRH.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcaggtgggtctgggacagaattcactctcaccatcagcagcctgcaacctgatgactttgcaacttattactgccaacagtataatggttatgaatccacttttggccaaggaccaagctggagatcaaacgaactgtggctgcacc

SEQ ID NO: 590847 - DNA, 503 bp, Homo sapiens
  misc_feature: HIJSMM301C8OU5.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcgagcccaa

SEQ ID NO: 590848 - DNA, 486 bp, Homo sapiens
  misc_feature: HIJSMM301E2RP5.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcacttcggtcggagggaccaaggtggagatcaaacgaaactgtggctgcacca

SEQ ID NO: 590849 - DNA, 506 bp, Homo sapiens
  misc_feature: HIJSMM301B07K7.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaaggtggaaagtacaaacgaactagtggctgcaccatctgtcttcatcttcccgtcca

SEQ ID NO: 590850 - DNA, 482 bp, Homo sapiens
  misc_feature: HIJSMM301CHVDH.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatacaaacgaactgtggctgcaccta

SEQ ID NO: 590851 - DNA, 517 bp, Homo sapiens
  misc_feature: HIJSMM301D61Q1.17.33.C11.1.454.light.4.raw
  modified_base (485)..(485): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaagcggtnccccctcggtcactctgttcccaccctcctcc

SEQ ID NO: 590852 - DNA, 520 bp, Homo sapiens
  misc_feature: HIJSMM301EYEPA.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcgtcactctgttcccgccct

SEQ ID NO: 590853 - DNA, 492 bp, Homo sapiens
  misc_feature: HIJSMM301BNJC9.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgagattttgcaacttattactgtctacaagattcttcttaccctcggacgtcgtccgacgggaccgacgtcggagtgtctaagacgaacgtagtggctgcaccatcttcg

SEQ ID NO: 590854 - DNA, 491 bp, Homo sapiens
  misc_feature: HIJSMM301CQFSI.43.34.D01.1.454.light.4.raw
  modified_base (332)..(332): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcgaggggtttcngatcgcttctctggctccaagtctggcaacacggcctccctgacaatctctgggctccaggctgaggacgaggctgattattattgctgctcatatgctaggttagttacacttatgttcttcggaattgggacgacggtcaccgtcctaggtcagccc

SEQ ID NO: 590855 - DNA, 498 bp, Homo sapiens
  misc_feature: HIJSMM301BQTTJ.49.29.C07.1.454.light.4.raw
agtcgagagacacgaccggtgctcgatttagagtgctacgaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 590856 - DNA, 484 bp, Homo sapiens; identical to SEQ ID NO: 540489
  misc_feature: HIJSMM301AO0ZW.7.75.G09.1.454.light.4.raw

SEQ ID NO: 590857 - DNA, 473 bp, Homo sapiens; identical to SEQ ID NO: 541472
  misc_feature: HIJSMM301C8CFZ.5.12.B01.1.454.light.4.raw

SEQ ID NO: 590858 - DNA, 485 bp, Homo sapiens; identical to SEQ ID NO: 536576
  misc_feature: HIJSMM301BJ9RS.46.35.D02.1.454.light.4.raw

SEQ ID NO: 590859 - DNA, 524 bp, Homo sapiens
  misc_feature: HIJSMM301BXRLA.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcacgcccaaggctcgccccctcggtcactctcgttcccaccct

SEQ ID NO: 590860 - DNA, 510 bp, Homo sapiens; identical to SEQ ID NO: 537801
  misc_feature: HIJSMM301DL802.5.60.F05.1.454.light.4.raw

SEQ ID NO: 590861 - DNA, 493 bp, Homo sapiens; identical to SEQ ID NO: 535047
  misc_feature: HIJSMM301BI354.16.53.E09.1.454.light.4.raw

SEQ ID NO: 590862 - DNA, 494 bp, Homo sapiens; identical to SEQ ID NO: 535629
  misc_feature: HIJSMM301ATHUC.4.27.C05.1.454.light.4.raw

SEQ ID NO: 590863 - DNA, 511 bp, Homo sapiens
  misc_feature: HIJSMM301CQ1MN.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaacgctgaccgtcctaggtcagcccaacggctgtcccccccg

SEQ ID NO: 590864 - DNA, 514 bp, Homo sapiens
  misc_feature: HIJSMM301AHUXL.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagctggccgtcctaggtcagcccaaggctgccccctcggtcactctgttccccgccctcctcgagtagtaca

SEQ ID NO: 590865 - DNA, 500 bp, Homo sapiens; identical to SEQ ID NO: 567048
  misc_feature: HIJSMM301BCE8F.5.86.H09.1.454.light.4.raw

SEQ ID NO: 590866 - DNA, 483 bp, Homo sapiens
  misc_feature: HIJSMM301EFU48.5.34.D01.1.454.light.4.raw
atcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagatttgcaacttactattgtcaacaggctaacagtttccctcgaccttcgccaaggacacgaactcggagattaaacgaactagtggctgcacca

SEQ ID NO: 590867 - DNA, 481 bp, Homo sapiens
  misc_feature: HIJSMM301B3P3U.48.34.D01.1.454.light.4.raw
agtatacatacacgaccggtgctcgatttagatcgtctgtgttgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggccg

SEQ ID NO: 590868 - DNA, 526 bp, Homo sapiens
  misc_feature: HIJSMM301EXMU8.49.40.D07.1.454.light.4.raw
agtcgagagacacgaccggtgctcgatttagtgatagagcgtaacaacagagggctgggcctcaggaagcagcatcggggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaaagacgccaaaacttgtcatattcggcggagggaccaaattgaccgtcctgggtcagcccaaggctgccccctggtccactctgttcccgcccctcctctctctcgta

SEQ ID NO: 590869 - DNA, 481 bp, Homo sapiens
  misc_feature: HIJSMM301CO57H.52.72.G06.1.454.light.4.raw
cgcagtacgacacgaccggtgctcgatttagctacgactgcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcgcgggggaccgaaggtggagatcaacgaaactgtgcgtgcacc

SEQ ID NO: 590870 - DNA, 501 bp, Homo sapiens
  misc_feature: HIJSMM301AST7O.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattatactgcaggtcatatacaatcagcaacacttatgtcttcgggactgggaccaagatcaccgtcctaggtcagcccaaggccaaccccactgtca

SEQ ID NO: 590871 - DNA, 454 bp, Homo sapiens; identical to SEQ ID NO: 534964
  misc_feature: HIJSMM301BRA5R.19.86.H09.1.454.light.4.raw

SEQ ID NO: 590872 - DNA, 504 bp, Homo sapiens
  misc_feature: HIJSMM301DYY1Z.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaaggaccaaggtggagatcaaacgaactgtggctgcaccatctgtcttcatcttcccgccat

SEQ ID NO: 590873 - DNA, 498 bp, Homo sapiens
  misc_feature: HIJSMM301B602Q.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccgaaggtaggagatcaaacgaacagtggctgcaccactctgtctt

SEQ ID NO: 590874 - DNA, 509 bp, Homo sapiens
  misc_feature: HIJSMM301CW8X9.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggttttttggcggtcgggacccagatgactgtcctcagtcagcccaaggctgccccctcggt

SEQ ID NO: 590875 - DNA, 521 bp, Homo sapiens; identical to SEQ ID NO: 538715
  misc_feature: HIJSMM301A156J.27.23.C01.1.454.light.4.raw

SEQ ID NO: 590876 - DNA, 484 bp, Homo sapiens; identical to SEQ ID NO: 548058
  misc_feature: HIJSMM301C0IM8.47.62.F07.1.454.light.4.raw

SEQ ID NO: 590877 - DNA, 493 bp, Homo sapiens
  misc_feature: HIJSMM301CYHYY.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtggtttgggacagacttcacgctcaccatcagcagcctagagcctgaagattttgcagtttattactgtcaacagcgttaccacaggattcactttcggccctgggaccagagtggatatcaaacgaactgtggctgcaccatctgtcttcatcttcccg

SEQ ID NO: 590878 - DNA, 479 bp, Homo sapiens
  misc_feature: HIJSMM301CYGIW.52.19.B08.1.454.light.4.raw
cgcagtacgacacgaccggtgctcgatttagtgagtcagtaaggggagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcataagtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccgaaggtggagatcaagcgaactgtggctgcaccatcttcg

SEQ ID NO: 590879 - DNA, 508 bp, Homo sapiens
  misc_feature: HIJSMM301AIBU1.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccccactgt

SEQ ID NO: 590880 - DNA, 486 bp, Homo sapiens; identical to SEQ ID NO: 551391
  misc_feature: HIJSMM301D2992.3.55.E11.1.454.light.4.raw

SEQ ID NO: 590881 - DNA, 479 bp, Homo sapiens
  misc_feature: HIJSMM301D1N8V.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggataaggcacagattttacactgaaaatcagcagagtggaggctgaggatgttggggtttattactgcatgcaagctctacaaactctgcggactttcggccctgggaccaaagtggagatcaaacgaa

SEQ ID NO: 590882 - DNA, 486 bp, Homo sapiens; identical to SEQ ID NO: 535385
  misc_feature: HIJSMM301CYCWH.19.71.G05.1.454.light.4.raw

SEQ ID NO: 590883 - DNA, 383 bp, Homo sapiens; identical to SEQ ID NO: 553009
  misc_feature: HIJSMM301D9YGQ.41.25.C03.1.454.light.4.raw

SEQ ID NO: 590884 - DNA, 513 bp, Homo sapiens
  misc_feature: HIJSMM301AYDQH.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccggtcctaggtcagccaaggctgccccctggtcactctgttccccg

SEQ ID NO: 590885 - DNA, 447 bp, Homo sapiens; identical to SEQ ID NO: 535201
  misc_feature: HIJSMM301BM63P.18.9.A09.1.454.light.4.raw

SEQ ID NO: 590886 - DNA, 513 bp, Homo sapiens; identical to SEQ ID NO: 545752
  misc_feature: HIJSMM301EB2WF.17.33.C11.1.454.light.4.raw

SEQ ID NO: 590887 - DNA, 444 bp, Homo sapiens; identical to SEQ ID NO: 537971
  misc_feature: HIJSMM301ENOKS.2.76.G10.1.454.light.4.raw

SEQ ID NO: 590888 - DNA, 506 bp, Homo sapiens; identical to SEQ ID NO: 543993
  misc_feature: HIJSMM301B1KJP.18.78.H01.1.454.light.4.raw

SEQ ID NO: 590889 - DNA, 506 bp, Homo sapiens; identical to SEQ ID NO: 547367
  misc_feature: HIJSMM301EVN0Q.16.46.E02.1.454.light.4.raw

SEQ ID NO: 590890 - DNA, 495 bp, Homo sapiens
  misc_feature: HIJSMM301BVI6W.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagtagttatccgtggacgttcggccaacgggaccgaggtggaatacaaacgaactagtggctgcaccatctgtcttc

SEQ ID NO: 590891 - DNA, 495 bp, Homo sapiens; identical to SEQ ID NO: 537415
  misc_feature: HIJSMM301EPBXR.4.27.C05.1.454.light.4.raw

SEQ ID NO: 590892 - DNA, 487 bp, Homo sapiens; identical to SEQ ID NO: 536536
  misc_feature: HIJSMM301DTYYF.26.45.E01.1.454.light.4.raw

SEQ ID NO: 590893 - DNA, 491 bp, Homo sapiens; identical to SEQ ID NO: 535294
  misc_feature: HIJSMM301BTVIQ.16.68.G02.1.454.light.4.raw

SEQ ID NO: 590894 - DNA, 501 bp, Homo sapiens
  misc_feature: HIJSMM301D3IOK.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcagggtttctagtcgcttctctgcctccaagtctggcaacacggcctccctgacaatctctgggctccaggctgacgacgaggctgaatattactgcagctcatatgtagatggtgcctctttcaaggttttcgcggaggaccaggctgaccgtcctaagtcagccaaggctgccccctcggt

SEQ ID NO: 590895 - DNA, 495 bp, Homo sapiens
  misc_feature: HIJSMM301A9WWF.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggctatttattactgcatgcaggctataccaccttcctgtcctacttttggccgaggggaccaagctggagatcgaggcgtaacg

SEQ ID NO: 590896 - DNA, 488 bp, Homo sapiens; identical to SEQ ID NO: 535990
  misc_feature: HIJSMM301ALZ81.11.28.C06.1.454.light.4.raw

SEQ ID NO: 590897 - DNA, 503 bp, Homo sapiens
  misc_feature: HIJSMM301A2607.2.71.G05.1.454.light.4.raw
acgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 590898 - DNA, 498 bp, Homo sapiens
  misc_feature: HIJSMM301CDWV2.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctgccccatcggtca

SEQ ID NO: 590899 - DNA, 490 bp, Homo sapiens; identical to SEQ ID NO: 535420
  misc_feature: HIJSMM301DGFOW.3.72.G06.1.454.light.4.raw

SEQ ID NO: 590900 - DNA, 488 bp, Homo sapiens; identical to SEQ ID NO: 535990
  misc_feature: HIJSMM301CY5I8.11.28.C06.1.454.light.4.raw

SEQ ID NO: 590901 - DNA, 485 bp, Homo sapiens
  misc_feature: HIJSMM301CGZ71.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcaggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 590902 - DNA, 508 bp, Homo sapiens
  misc_feature: HIJSMM301D4JOX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgataacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaagtacaaacgaactagtggctgcaccatctgtcttcatcttccccg

SEQ ID NO: 590903 - DNA, 478 bp, Homo sapiens; identical to SEQ ID NO: 535129
  misc_feature: HIJSMM301BBQK8.11.11.A11.1.454.light.4.raw

SEQ ID NO: 590904 - DNA, 479 bp, Homo sapiens; identical to SEQ ID NO: 545213
  misc_feature: HIJSMM301ELOKV.40.59.F04.1.454.light.4.raw

SEQ ID NO: 590905 - DNA, 486 bp, Homo sapiens; identical to SEQ ID NO: 535043
  misc_feature: HIJSMM301BCNKJ.46.35.D02.1.454.light.4.raw

SEQ ID NO: 590906 - DNA, 483 bp, Homo sapiens; identical to SEQ ID NO: 577483
  misc_feature: HIJSMM301ERVUN.46.26.C04.1.454.light.4.raw

SEQ ID NO: 590907 - DNA, 486 bp, Homo sapiens; identical to SEQ ID NO: 535043
  misc_feature: HIJSMM301CQH6T.46.35.D02.1.454.light.4.raw

SEQ ID NO: 590908 - DNA, 490 bp, Homo sapiens
  misc_feature: HIJSMM301D0G70.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggaggaccgaagtggaggtcaaacgaactgtggctgcaccatctgtcttcatt

SEQ ID NO: 590909 - DNA, 475 bp, Homo sapiens
  misc_feature: HIJSMM301AV23G.4.16.B05.1.454.light.4.raw
agcactgtagcacgaccggtgctcgatttagagctcacgtaaggggatcaggactcctcagttcaccttctcacaatgaggctccctgctcagctcctggggctgctaatgctctgggtctctggatccagtggggatattgtgatgactcagtctccactctccctgtccgtcacccctggagagacggcctccatctcctgcaggtcgagtcagagcctcctgcacagtaatggatacaactatttggattggtacctgcagaagccagggcagtctccacagctcctgatctatttggtttctaatcgggcctccggggtccctgacaggttcagtggcagtggatcaggcacagattttacactgacaatcagcagagtggaggctgaggatgttggggtttattactgcatgcaagctctacaaactccggtcactttcggcggagggaccaaggtggagatcaaacgaa

SEQ ID NO: 590910 - DNA, 447 bp, Homo sapiens; identical to SEQ ID NO: 535201
  misc_feature: HIJSMM301CAFL8.18.9.A09.1.454.light.4.raw

SEQ ID NO: 590911 - DNA, 488 bp, Homo sapiens; identical to SEQ ID NO: 537260
  misc_feature: HIJSMM301CXM7M.47.70.G04.1.454.light.4.raw

SEQ ID NO: 590912 - DNA, 496 bp, Homo sapiens; identical to SEQ ID NO: 573952
  misc_feature: HIJSMM301CH0H3.16.78.H01.1.454.light.4.raw

SEQ ID NO: 590913 - DNA, 521 bp, Homo sapiens; identical to SEQ ID NO: 539470
  misc_feature: HIJSMM301BM4AK.27.23.C01.1.454.light.4.raw

SEQ ID NO: 590914 - DNA, 500 bp, Homo sapiens
  misc_feature: HIJSMM301A3KA7.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcctgggaccaaagtggagatcaaacgaactgtggctgcaccatctgtcttcta

SEQ ID NO: 590915 - DNA, 495 bp, Homo sapiens; identical to SEQ ID NO: 535821
  misc_feature: HIJSMM301AL23V.3.31.C09.1.454.light.4.raw

SEQ ID NO: 590916 - DNA, 500 bp, Homo sapiens
  misc_feature: HIJSMM301BURKR.43.53.E09.1.454.light.4.raw
tgtgagtagtcacgaccggtgctcgatttagagagagtgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccta

SEQ ID NO: 590917 - DNA, 518 bp, Homo sapiens; identical to SEQ ID NO: 539372
  misc_feature: HIJSMM301BP48A.7.86.H09.1.454.light.4.raw

SEQ ID NO: 590918 - DNA, 506 bp, Homo sapiens; identical to SEQ ID NO: 563474
  misc_feature: HIJSMM301EE3NH.10.27.C05.1.454.light.4.raw

SEQ ID NO: 590919 - DNA, 497 bp, Homo sapiens
  misc_feature: HIJSMM301B7EZO.43.60.F05.1.454.light.4.raw
tgtgagtagtcacgaccggtgctcgatttagtacgtcatcagggaaagggcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccagggaccgacggtcggt

SEQ ID NO: 590920 - DNA, 505 bp, Homo sapiens; identical to SEQ ID NO: 543569
  misc_feature: HIJSMM301BX8PO.10.12.B01.1.454.light.4.raw

SEQ ID NO: 590921 - DNA, 497 bp, Homo sapiens
  misc_feature: HIJSMM301EPRV2.51.61.F06.1.454.light.4.raw
cgatcgtatacacgaccggtgctcgatttagctacgctctaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggtccgaagggaaccgaacggtaggaaagtactaaacgaaacctagtggctgcgaccatactgtt

SEQ ID NO: 590922 - DNA, 491 bp, Homo sapiens
  misc_feature: HIJSMM301CJ17B.7.75.G09.1.454.light.4.raw
  modified_base (461)..(461): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcgggcggtggatctagggcagatttcactctcaccatcaatcacctgcaggctgaggtattttgctaacttactactgtcagcaggctaacaggctcgcccccaaccttccggccaggggacacgactgganattaaacgaactgtggctgcaccatctgtt

SEQ ID NO: 590923 - DNA, 492 bp, Homo sapiens
  misc_feature: HIJSMM301DR14D.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaacgaactgtggctgcaccatctgtcttcatcttcccgcat

SEQ ID NO: 590924 - DNA, 460 bp, Homo sapiens
  misc_feature: HIJSMM301EOX7B.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggtttttggcggagggaccaagctgaccgtcctaggtcagcccaaggctgccccctcggtcactctgttcccaccctcctcgtatctctcg

SEQ ID NO: 590925 - DNA, 502 bp, Homo sapiens
  misc_feature: HIJSMM301AYTI6.4.71.G05.1.454.light.4.raw
  modified_base (237)..(237): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctagtcagcccaaggctgcccctcggtcactctgtt

SEQ ID NO: 590926 - DNA, 514 bp, Homo sapiens
  misc_feature: HIJSMM301EMQ6N.49.71.G05.1.454.light.4.raw
agtcgagagacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcattctgttcccgccctcct

SEQ ID NO: 590927 - DNA, 479 bp, Homo sapiens
  misc_feature: HIJSMM301AP6QS.51.73.G07.1.454.light.4.raw
cgatcgtatacacgaccggtgctcgatttagctctacgctcagggcacgaccggtgctcgatttagtgtgagtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggc

SEQ ID NO: 590928 - DNA, 498 bp, Homo sapiens
  misc_feature: HIJSMM301DA9GZ.43.62.F07.1.454.light.4.raw
  modified_base (393)..(393): a, c, t, g, unknown or other
tgtgagtagtcacgaccggtgctcgatttagtagtcgcataaagggaaagggggcaggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagnttatgcaacttacttctgtcaacagagtgacagaaacccgtggacgttcggccaagggaccaaggtggaaagcaaacgaactgtggctgcaccatctgtcttcta

SEQ ID NO: 590929 - DNA, 484 bp, Homo sapiens; identical to SEQ ID NO: 535400
  misc_feature: HIJSMM301AEYKT.46.26.C04.1.454.light.4.raw

SEQ ID NO: 590930 - DNA, 484 bp, Homo sapiens
  misc_feature: HIJSMM301B66XI.52.55.E11.1.454.light.4.raw
cgcagtacgacacgaccggtgctcgatttagcactcgcacgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtggacactggcatttgggtgttcggcggagggaccaagttgaccgtcctaggtcagcccaaggctccg

SEQ ID NO: 590931 - DNA, 486 bp, Homo sapiens; identical to SEQ ID NO: 562202
  misc_feature: HIJSMM301AK1EU.43.4.A04.1.454.light.4.raw

SEQ ID NO: 590932 - DNA, 513 bp, Homo sapiens
  misc_feature: HIJSMM301AVZ5S.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaaggctgaccgtcctaggtcagcccaaggctgccccctcggtcactctcgttcccgt

SEQ ID NO: 590933 - DNA, 494 bp, Homo sapiens
  misc_feature: HIJSMM301ATIKG.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagctcggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcaccat

SEQ ID NO: 590934 - DNA, 494 bp, Homo sapiens
  misc_feature: HIJSMM301DA2I1.48.32.C10.1.454.light.4.raw
agtatacatacacgaccggtgctcgatttagtatagacatcaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaaacgactgtggctgcaccatctgt

SEQ ID NO: 590935 - DNA, 498 bp, Homo sapiens; identical to SEQ ID NO: 553247
  misc_feature: HIJSMM301C6D6C.40.57.F02.1.454.light.4.raw

SEQ ID NO: 590936 - DNA, 510 bp, Homo sapiens; identical to SEQ ID NO: 576631
  misc_feature: HIJSMM301BABA4.9.52.E08.1.454.light.4.raw

SEQ ID NO: 590937 - DNA, 482 bp, Homo sapiens
  misc_feature: HIJSMM301BA0MD.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaggtgagatcaaacgaa

SEQ ID NO: 590938 - DNA, 491 bp, Homo sapiens
  misc_feature: HIJSMM301AGYRS.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcccctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccat

SEQ ID NO: 590939 - DNA, 494 bp, Homo sapiens; identical to SEQ ID NO: 543077
  misc_feature: HIJSMM301DGARE.15.26.C04.1.454.light.4.raw

SEQ ID NO: 590940 - DNA, 508 bp, Homo sapiens
  misc_feature: HIJSMM301B3MNB.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtctacc

SEQ ID NO: 590941 - DNA, 447 bp, Homo sapiens; identical to SEQ ID NO: 535020
  misc_feature: HIJSMM301EHQVW.18.9.A09.1.454.light.4.raw

SEQ ID NO: 590942 - DNA, 481 bp, Homo sapiens
  misc_feature: HIJSMM301AMJJ2.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaaggtgcagatcaaacgaaactgtgg

SEQ ID NO: 590943 - DNA, 481 bp, Homo sapiens
  misc_feature: HIJSMM301AE6VB.51.33.C11.1.454.light.4.raw
cgatcgtatacacgaccggtgctcgatttagagtgagctcgttgggtttggggcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttctaccatcagcaggctgcagcctgaagacattgcaacatattactgtcaacagtatgatagtctcccgctcacttcggtcgggggaccggaaggtggagatacaagacgaactacgtggcgtg

SEQ ID NO: 590944 - DNA, 507 bp, Homo sapiens
  misc_feature: HIJSMM301BTFCH.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaggctgccccctggtcactctcg

SEQ ID NO: 590945 - DNA, 502 bp, Homo sapiens; identical to SEQ ID NO: 541971
  misc_feature: HIJSMM301BDUFO.4.39.D06.1.454.light.4.raw

SEQ ID NO: 590946 - DNA, 467 bp, Homo sapiens; identical to SEQ ID NO: 541349
  misc_feature: HIJSMM301A0ELM.4.75.G09.1.454.light.4.raw

SEQ ID NO: 590947 - DNA, 489 bp, Homo sapiens
  misc_feature: HIJSMM301APJMV.46.26.C04.1.454.light.4.raw
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgcctcactttcggtcggagggaccgaaggtaggaggatcaaacgaaa

SEQ ID NO: 590948 - DNA, 499 bp, Homo sapiens; identical to SEQ ID NO: 543600
  misc_feature: HIJSMM301BM2U3.14.23.C01.1.454.light.4.raw

SEQ ID NO: 590949 - DNA, 377 bp, Homo sapiens; identical to SEQ ID NO: 536071
  misc_feature: HIJSMM301A9YNG.40.9.A09.1.454.light.4.raw

SEQ ID NO: 590950 - DNA, 498 bp, Homo sapiens
  misc_feature: HIJSMM301CDZMJ.9.21.B10.1.454.light.4.raw
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctg

SEQ ID NO: 590951 - DNA, 488 bp, Homo sapiens; identical to SEQ ID NO: 535081
  misc_feature: HIJSMM301EHN0P.26.23.C01.1.454.light.4.raw

SEQ ID NO: 590952 - DNA, 499 bp, Homo sapiens
  misc_feature: HIJSMM301AG9LQ.48.73.G07.1.454.light.4.raw
agtatacatacacgaccggtgctcgatttagctctacgctcagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgactgtggctgcaccatctgtcttcatcttccccg

SEQ ID NO: 590953 - DNA, 514 bp, Homo sapiens; identical to SEQ ID NO: 543870
  misc_feature: HIJSMM301APG7K.40.12.B01.1.454.light.4.raw

SEQ ID NO: 590954 - DNA, 471 bp, Homo sapiens; identical to SEQ ID NO: 579376
  misc_feature: HIJSMM301DS7X5.49.4.A04.1.454.light.4.raw

SEQ ID NO: 590955 - DNA, 460 bp, Homo sapiens; identical to SEQ ID NO: 536053
  misc_feature: HIJSMM301BRV71.22.28.C06.1.454.light.4.raw

SEQ ID NO: 590956 - DNA, 508 bp, Homo sapiens
  misc_feature: HIJSMM301C9AF1.49.34.D01.1.454.light.4.raw
agtcgagagacacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggcgggaccaggctgaccgtcctgggtcagcccaaggctgccccctcggtcactctgttcccg

SEQ ID NO: 590957 - DNA, 494 bp, Homo sapiens; identical to SEQ ID NO: 534992
  misc_feature: HIJSMM301AQUAC.9.1.A01.1.454.light.4.raw

SEQ ID NO: 590958 - DNA, 504 bp, Homo sapiens
  misc_feature: HIJSMM301AW89I.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtcttcatcttcctgcc

SEQ ID NO: 590959 - DNA, 498 bp, Homo sapiens
  misc_feature: HIJSMM301A9R80.53.4.A04.1.454.light.4.raw
cgcgtatacacacgaccggtgctcgatttagagtagtgatcagggggggcacaagaggcagcactcaggacaatctccagcatggcctggtctcctctcctcctcactctcctcgctcactgcacagggtcctgggcccagtctgttctgacgcagccgccctcagtgtctggggccccagggcagagggttatcatctcctgcactgggaccagctccaacatcgggtcaggttatgatgtacactggtaccagcagcttccaggaacagcccccaaactcctcgtctatggtgacggcagtcggccctcaggggtccctggccgattctctggctccaagtctggcacctcagcctccctggccatcactgggctccaggctgaggatgagggtcattattactgccagtcctatgacaacagaatggatccttcttgggtgttcgggcggagggaccaagctgaccgtcctacgtcagcccaaggctgccccctc

SEQ ID NO: 590960 - DNA, 489 bp, Homo sapiens; identical to SEQ ID NO: 535139
  misc_feature: HIJSMM301C11UL.14.55.E11.1.454.light.4.raw

SEQ ID NO: 590961 - DNA, 488 bp, Homo sapiens
  misc_feature: HIJSMM301A8818.52.52.E08.1.454.light.4.raw
cgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcagggtggaggctgaagatgttggggtttattactgcatgcaaggcacacactgcctgcgtacacttttggccagggaccaagctggagaggaaacgaact

SEQ ID NO: 590962 - DNA, 497 bp, Homo sapiens
  misc_feature: HIJSMM301AJKWZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactaggagaattaacgaaactgtggctgcaccactctgtctt

SEQ ID NO: 590963 - DNA, 499 bp, Homo sapiens
  misc_feature: HIJSMM301C18HY.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtaggaaatcaaacgaactgtggctgcaccta

SEQ ID NO: 590964 - DNA, 508 bp, Homo sapiens
  misc_feature: HIJSMM301A50CW.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattggggtgttcgggcggagggaccaaggctgaccgtcctaagtcagcccaaggctgccccctcggtcactctgttcccgccct

SEQ ID NO: 590965 - DNA, 495 bp, Homo sapiens
  misc_feature: HIJSMM301DWLLF.19.21.B10.1.454.light.4.raw
tactctcgtgcacgaccggtgctcgatttagtgtcgtcgcaagagaggaggggggtacaacaggcaggcaggggcagcaagatggtgttgcagacccaggtcttcatttctctgttgctctggatctctggtgcccgacggggacatcgtgatgacccagtctccagactccctggctgtgtctctgggcgagcgggccaccatcaactgcaagtccagccacaattcttttatacagttccaacaatagaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcgccaaggaccaaggtggatatcagacgaactgtggctgca

SEQ ID NO: 590966 - DNA, 497 bp, Homo sapiens
  misc_feature: HIJSMM301BKQDO.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatacaaacgaactgtggctgcaccatctgtctt

SEQ ID NO: 590967 - DNA, 491 bp, Homo sapiens
  misc_feature: HIJSMM301EXVQN.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcgggaccaaacgtaggatatcaaacgaaactagtggctgcaccatctgtt

SEQ ID NO: 590968 - DNA, 472 bp, Homo sapiens; identical to SEQ ID NO: 555621
  misc_feature: HIJSMM301EQIL2.3.82.H05.1.454.light.4.raw

SEQ ID NO: 590969 - DNA, 484 bp, Homo sapiens
  misc_feature: HIJSMM301AQFMP.41.57.F02.1.454.light.4.raw
tctatactatcacgaccggtgctcgatttagctcgatatagttgggtttggggaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcacaaattggatgttcggcggagggaccaagctgaccgtcctaggtcacg

SEQ ID NO: 590970 - DNA, 495 bp, Homo sapiens; identical to SEQ ID NO: 543094
  misc_feature: HIJSMM301DFD4S.22.57.F02.1.454.light.4.raw

SEQ ID NO: 590971 - DNA, 486 bp, Homo sapiens
  misc_feature: HIJSMM301EL218.46.57.F02.1.454.light.4.raw
actagcagtacacgaccggtgctcgatttagctcgatatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgtaac

SEQ ID NO: 590972 - DNA, 512 bp, Homo sapiens
  misc_feature: HIJSMM301ES5KL.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacccttct

SEQ ID NO: 590973 - DNA, 494 bp, Homo sapiens; identical to SEQ ID NO: 534992
  misc_feature: HIJSMM301DTPLC.9.1.A01.1.454.light.4.raw

SEQ ID NO: 590974 - DNA, 498 bp, Homo sapiens
  misc_feature: HIJSMM301CZNUC.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccgaagggaccaacggtggaaagtacaaacgaactagtggctgcgaccactctgtt

SEQ ID NO: 590975 - DNA, 505 bp, Homo sapiens; identical to SEQ ID NO: 539204
  misc_feature: HIJSMM301A38B1.17.41.D08.1.454.light.4.raw

SEQ ID NO: 590976 - DNA, 515 bp, Homo sapiens
  misc_feature: HIJSMM301DQ7CM.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccctcct

SEQ ID NO: 590977 - DNA, 494 bp, Homo sapiens; identical to SEQ ID NO: 534994
  misc_feature: HIJSMM301EQZ9X.27.78.H01.1.454.light.4.raw

SEQ ID NO: 590978 - DNA, 496 bp, Homo sapiens; identical to SEQ ID NO: 536802
  misc_feature: HIJSMM301CLMHC.5.24.C02.1.454.light.4.raw

SEQ ID NO: 590979 - DNA, 494 bp, Homo sapiens; identical to SEQ ID NO: 534994
  misc_feature: HIJSMM301AXHYM.27.78.H01.1.454.light.4.raw

SEQ ID NO: 590980 - DNA, 488 bp, Homo sapiens; identical to SEQ ID NO: 538291
  misc_feature: HIJSMM301ADQP4.19.71.G05.1.454.light.4.raw

SEQ ID NO: 590981 - DNA, 484 bp, Homo sapiens; identical to SEQ ID NO: 535240
  misc_feature: HIJSMM301C5EPM.47.60.F05.1.454.light.4.raw

SEQ ID NO: 590982 - DNA, 505 bp, Homo sapiens; identical to SEQ ID NO: 536254
  misc_feature: HIJSMM301DI5UO.7.71.G05.1.454.light.4.raw

SEQ ID NO: 590983 - DNA, 511 bp, Homo sapiens; identical to SEQ ID NO: 537464
  misc_feature: HIJSMM301A2V5P.7.34.D01.1.454.light.4.raw

SEQ ID NO: 590984 - DNA, 506 bp, Homo sapiens; identical to SEQ ID NO: 583265
  misc_feature: HIJSMM301CSZ4A.8.42.D09.1.454.light.4.raw

SEQ ID NO: 590985 - DNA, 485 bp, Homo sapiens; identical to SEQ ID NO: 582490
  misc_feature: HIJSMM301DDM3B.47.46.E02.1.454.light.4.raw

SEQ ID NO: 590986 - DNA, 488 bp, Homo sapiens
  misc_feature: HIJSMM301EIPRR.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggcctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 590987 - DNA, 460 bp, Homo sapiens; identical to SEQ ID NO: 536053
  misc_feature: HIJSMM301EKT0L.22.28.C06.1.454.light.4.raw

SEQ ID NO: 590988 - DNA, 509 bp, Homo sapiens
  misc_feature: HIJSMM301CNV98.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctagtcagccaaggccaacccactgtcactctcg

SEQ ID NO: 590989 - DNA, 444 bp, Homo sapiens; identical to SEQ ID NO: 534993
  misc_feature: HIJSMM301BPLKL.5.9.A09.1.454.light.4.raw

SEQ ID NO: 590990 - DNA, 507 bp, Homo sapiens; identical to SEQ ID NO: 590944
  misc_feature: HIJSMM301DK01N.9.55.E11.1.454.light.4.raw

SEQ ID NO: 590991 - DNA, 487 bp, Homo sapiens; identical to SEQ ID NO: 536206
  misc_feature: HIJSMM301D3BIO.47.38.D05.1.454.light.4.raw

SEQ ID NO: 590992 - DNA, 486 bp, Homo sapiens; identical to SEQ ID NO: 535917
  misc_feature: HIJSMM301CLKYE.3.10.A10.1.454.light.4.raw

SEQ ID NO: 590993 - DNA, 494 bp, Homo sapiens; identical to SEQ ID NO: 534992
  misc_feature: HIJSMM301DKK6D.9.1.A01.1.454.light.4.raw

SEQ ID NO: 590994 - DNA, 492 bp, Homo sapiens
  misc_feature: HIJSMM301EAR6C.49.27.C05.1.454.light.4.raw
agtcgagagacacgaccggtgctcgatttagacgcgatcgaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 590995 - DNA, 505 bp, Homo sapiens; identical to SEQ ID NO: 539292
  misc_feature: HIJSMM301DSIZN.19.85.H08.1.454.light.4.raw

SEQ ID NO: 590996 - DNA, 491 bp, Homo sapiens; identical to SEQ ID NO: 538021
  misc_feature: HIJSMM301CX6YM.3.72.G06.1.454.light.4.raw

SEQ ID NO: 590997 - DNA, 481 bp, Homo sapiens; identical to SEQ ID NO: 535993
  misc_feature: HIJSMM301AXBMU.21.25.C03.1.454.light.4.raw

SEQ ID NO: 590998 - DNA, 488 bp, Homo sapiens; identical to SEQ ID NO: 535081
  misc_feature: HIJSMM301C675W.26.23.C01.1.454.light.4.raw

SEQ ID NO: 590999 - DNA, 488 bp, Homo sapiens
  misc_feature: HIJSMM301BQAK0.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaagggtggagatcaaacgaact

SEQ ID NO: 591000 - DNA, 486 bp, Homo sapiens
  misc_feature: HIJSMM301D0FWU.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaaactgaccgtcctaggtcaagcccaaggctgcccccc

SEQ ID NO: 591001 - DNA, 499 bp, Homo sapiens
  misc_feature: HIJSMM301ALSEW.48.73.G07.1.454.light.4.raw
agtatacatacacgaccggtgctcgatttagctctacgctcagggcacgaccggtgctcgatttagctcgatatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgacccg

SEQ ID NO: 591002 - DNA, 485 bp, Homo sapiens; identical to SEQ ID NO: 536040
  misc_feature: HIJSMM301D8IIV.15.1.A01.1.454.light.4.raw

SEQ ID NO: 591003 - DNA, 503 bp, Homo sapiens; identical to SEQ ID NO: 537518
  misc_feature: HIJSMM301D6OKL.8.19.B08.1.454.light.4.raw

SEQ ID NO: 591004 - DNA, 468 bp, Homo sapiens; identical to SEQ ID NO: 551278
  misc_feature: HIJSMM301A0UKP.48.39.D06.1.454.light.4.raw

SEQ ID NO: 591005 - DNA, 485 bp, Homo sapiens; identical to SEQ ID NO: 536075
  misc_feature: HIJSMM301DDVE1.17.21.B10.1.454.light.4.raw

SEQ ID NO: 591006 - DNA, 494 bp, Homo sapiens; identical to SEQ ID NO: 534992
  misc_feature: HIJSMM301B5MR9.9.1.A01.1.454.light.4.raw

SEQ ID NO: 591007 - DNA, 487 bp, Homo sapiens
  misc_feature: HIJSMM301BPJHB.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtaccccccccacgttcggcggacggaccgacagtcgagatacaaacgaactgtggctgcacact

SEQ ID NO: 591008 - DNA, 513 bp, Homo sapiens
  misc_feature: HIJSMM301A33PZ.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaatatgtttattggtaccaacagaagtcaggccaggcccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccaccctcct

SEQ ID NO: 591009 - DNA, 523 bp, Homo sapiens
  misc_feature: HIJSMM301DUB6Y.17.31.C09.1.454.light.4.raw
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacg

SEQ ID NO: 591010 - DNA, 509 bp, Homo sapiens; identical to SEQ ID NO: 547302
  misc_feature: HIJSMM301A06VC.4.57.F02.1.454.light.4.raw

SEQ ID NO: 591011 - DNA, 488 bp, Homo sapiens; identical to SEQ ID NO: 544026
  misc_feature: HIJSMM301BUYAP.14.55.E11.1.454.light.4.raw

SEQ ID NO: 591012 - DNA, 506 bp, Homo sapiens; identical to SEQ ID NO: 534969
  misc_feature: HIJSMM301CA9CX.18.37.D04.1.454.light.4.raw

SEQ ID NO: 591013 - DNA, 480 bp, Homo sapiens
  misc_feature: HIJSMM301ATJ69.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctggctccaggctgacgatgaggctgattattattgccagtcctatgacaacaccctgcgtggttttggtctgttcggcggcggacg

SEQ ID NO: 591014 - DNA, 487 bp, Homo sapiens; identical to SEQ ID NO: 541583
  misc_feature: HIJSMM301EDMF6.41.57.F02.1.454.light.4.raw

SEQ ID NO: 591015 - DNA, 478 bp, Homo sapiens; identical to SEQ ID NO: 555324
  misc_feature: HIJSMM301A0XUG.13.59.F04.1.454.light.4.raw

SEQ ID NO: 591016 - DNA, 520 bp, Homo sapiens; identical to SEQ ID NO: 556231
  misc_feature: HIJSMM301C7IV6.41.19.B08.1.454.light.4.raw

SEQ ID NO: 591017 - DNA, 471 bp, Homo sapiens
  misc_feature: HIJSMM301EM0PU.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtgacgttcgccaaggaccaaggtgaaagtacaaacgaactagtgg

SEQ ID NO: 591018 - DNA, 471 bp, Homo sapiens; identical to SEQ ID NO: 537461
  misc_feature: HIJSMM301ESQ6H.7.81.H04.1.454.light.4.raw

SEQ ID NO: 591019 - DNA, 501 bp, Homo sapiens; identical to SEQ ID NO: 579640
  misc_feature: HIJSMM301BEVEJ.9.81.H04.1.454.light.4.raw

SEQ ID NO: 591020 - DNA, 383 bp, Homo sapiens; identical to SEQ ID NO: 447524
  misc_feature: HIJSMM301AVDBZ.41.26.C04.1.454.light.4.raw

SEQ ID NO: 591021 - DNA, 515 bp, Homo sapiens
  misc_feature: HIJSMM301B00DO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccgaacggaccgaaggtaggaaatacaaacgaactagtggcgtgcaccactcttcgtcttctattccttccccg

SEQ ID NO: 591022 - DNA, 512 bp, Homo sapiens
  misc_feature: HIJSMM301DYYMH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaaactgggcatctacccggcaatccggggtccctgaccgattcagtggcagcgggtctgggacagatttcactctcaccatcagcagcctgcaggctgaagatgtggcagtttattactgtcaacagttttctcgggcgtgtccaggaccgaacggtaggaagtacaaacgaaactaacgtaggcgtgcaccaactactctcttctatacttccc

SEQ ID NO: 591023 - DNA, 520 bp, Homo sapiens
  misc_feature: HIJSMM301DIEZT.14.70.G04.1.454.light.4.raw
cgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactcgtcactctcg

SEQ ID NO: 591024 - DNA, 514 bp, Homo sapiens; identical to SEQ ID NO: 541418
  misc_feature: HIJSMM301B87CH.17.33.C11.1.454.light.4.raw

SEQ ID NO: 591025 - DNA, 496 bp, Homo sapiens; identical to SEQ ID NO: 546162
  misc_feature: HIJSMM301BDDLR.7.5.A05.1.454.light.4.raw

SEQ ID NO: 591026 - DNA, 516 bp, Homo sapiens; identical to SEQ ID NO: 536439
  misc_feature: HIJSMM301A3KDI.14.66.F11.1.454.light.4.raw

SEQ ID NO: 591027 - DNA, 486 bp, Homo sapiens
  misc_feature: HIJSMM301EGJNG.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccctactttcggccctgggaccaaagtggatatcaaacgaactgtggctgcaccatctgt

SEQ ID NO: 591028 - DNA, 486 bp, Homo sapiens
  misc_feature: HIJSMM301CGB9Z.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggccaagctgaccgtcctaggtcacg

SEQ ID NO: 591029 - DNA, 526 bp, Homo sapiens
  misc_feature: HIJSMM301D4PVJ.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcactcgtcctaggtcacgcccaacggccaaccccactcgtcactcttcgttcccgccctcct

SEQ ID NO: 591030 - DNA, 495 bp, Homo sapiens
  misc_feature: HIJSMM301B44P1.21.9.A09.1.454.light.4.raw
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcctgatgattttgcaacttattactgccaacattacaatgattactcgcgtacgttcggccgaagggaccgagggtggaaatacaaacgaactgtggctgcaccatctgtcttcta

SEQ ID NO: 591031 - DNA, 490 bp, Homo sapiens; identical to SEQ ID NO: 535234
  misc_feature: HIJSMM301C9DRE.17.21.B10.1.454.light.4.raw

SEQ ID NO: 591032 - DNA, 522 bp, Homo sapiens
  misc_feature: HIJSMM301B2V6A.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacactttgggtgttcggcggagggaccaggctgaccgtcctaggtcagcccaaggctgccccctcggtcactctgttcccgccct

SEQ ID NO: 591033 - DNA, 503 bp, Homo sapiens
  misc_feature: HIJSMM301BEKLJ.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctagccctgactcagcctccctccgcgtccaggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattggcggagggaccaaactgaccgtcctaggtcagcccaaggctgccccccg

SEQ ID NO: 591034 - DNA, 490 bp, Homo sapiens; identical to SEQ ID NO: 574057
  misc_feature: HIJSMM301B6JZ1.51.53.E09.1.454.light.4.raw

SEQ ID NO: 591035 - DNA, 507 bp, Homo sapiens
  misc_feature: HIJSMM301C6I2U.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgtattttggcggaggcaccaaggtgaccgtcctaagtcagcccaaggctcgccccctcggtcta

SEQ ID NO: 591036 - DNA, 474 bp, Homo sapiens
  misc_feature: HIJSMM301B6GCF.5.70.G04.1.454.light.4.raw
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgctcactttcggcggagggaccaaggtggagatcaaacgaactgtgg

SEQ ID NO: 591037 - DNA, 503 bp, Homo sapiens; identical to SEQ ID NO: 567708
  misc_feature: HIJSMM301B84AB.21.81.H04.1.454.light.4.raw

SEQ ID NO: 591038 - DNA, 505 bp, Homo sapiens
  misc_feature: HIJSMM301C55A2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaggaccgaaggtaggaaagtacaaacgaacagtggcgtgcaccatctgtcttctatcttcccg

SEQ ID NO: 591039 - DNA, 508 bp, Homo sapiens
  misc_feature: HIJSMM301B8M31.21.22.B11.1.454.light.4.raw
  modified_base (462)..(462): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtgggctccgggtccgaggatgaggctgactattactgtgcatcacgggacgcaacatgggatgacaatctgagcgggttggnggttcggcggagggaccaaacgtgacccgtcctaggtcagccccaa

SEQ ID NO: 591040 - DNA, 489 bp, Homo sapiens
  misc_feature: HIJSMM301BCOC5.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggaggaccgaaggttgagatcaaacgaactgtggctgcaccta

SEQ ID NO: 591041 - DNA, 502 bp, Homo sapiens
  misc_feature: HIJSMM301EXPVE.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaaggcccaaccccactgtca

SEQ ID NO: 591042 - DNA, 500 bp, Homo sapiens; identical to SEQ ID NO: 540012
  misc_feature: HIJSMM301D68X2.52.34.D01.1.454.light.4.raw

SEQ ID NO: 591043 - DNA, 444 bp, Homo sapiens
  misc_feature: HIJSMM301C70TH.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttctcaccctcctccactactatg

SEQ ID NO: 591044 - DNA, 494 bp, Homo sapiens; identical to SEQ ID NO: 534994
  misc_feature: HIJSMM301EQS5R.27.78.H01.1.454.light.4.raw

SEQ ID NO: 591045 - DNA, 498 bp, Homo sapiens
  misc_feature: HIJSMM301AW3TC.26.78.H01.1.454.light.4.raw
  modified_base (482)..(482): a, c, t, g, unknown or other
agactatactcacgaccggtgctcgatttagtgtgagtagtttgggtttggggcgagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtatttttgctactttattactgtcagcagcgtagcaactggcctctcactttcggcggacgggaccgacgggtggaagntcagacgaactgtcgg

SEQ ID NO: 591046 - DNA, 480 bp, Homo sapiens
  misc_feature: HIJSMM301BWGTK.51.64.F09.1.454.light.4.raw
cgatcgtatacacgaccggtgctcgatttagcgcgtatacaagggaggggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacc

SEQ ID NO: 591047 - DNA, 504 bp, Homo sapiens
  misc_feature: HIJSMM301EIJ1G.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttccttttgtcttcggaactgggaccgaggtccaccgtcctaggtcagcccaaggccaaccccactgtcta

SEQ ID NO: 591048 - DNA, 515 bp, Homo sapiens
  misc_feature: HIJSMM301A5G2E.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctccgagtagtaca

SEQ ID NO: 591049 - DNA, 442 bp, Homo sapiens
  misc_feature: HIJSMM301A7071.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctcgttcccgccctcctcgtatctctcg

SEQ ID NO: 591050 - DNA, 497 bp, Homo sapiens; identical to SEQ ID NO: 553226
  misc_feature: HIJSMM301DRI6J.16.78.H01.1.454.light.4.raw

SEQ ID NO: 591051 - DNA, 486 bp, Homo sapiens; identical to SEQ ID NO: 535043
  misc_feature: HIJSMM301CVKGW.46.35.D02.1.454.light.4.raw

SEQ ID NO: 591052 - DNA, 496 bp, Homo sapiens; identical to SEQ ID NO: 551761
  misc_feature: HIJSMM301CPUKN.4.27.C05.1.454.light.4.raw

SEQ ID NO: 591053 - DNA, 492 bp, Homo sapiens; identical to SEQ ID NO: 535126
  misc_feature: HIJSMM301ED83S.18.11.A11.1.454.light.4.raw

SEQ ID NO: 591054 - DNA, 513 bp, Homo sapiens
  misc_feature: HIJSMM301EDY4H.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaaacacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 591055 - DNA, 483 bp, Homo sapiens; identical to SEQ ID NO: 550486
  misc_feature: HIJSMM301DAK1I.49.34.D01.1.454.light.4.raw

SEQ ID NO: 591056 - DNA, 496 bp, Homo sapiens; identical to SEQ ID NO: 537925
  misc_feature: HIJSMM301C5OF5.22.14.B03.1.454.light.4.raw

SEQ ID NO: 591057 - DNA, 445 bp, Homo sapiens
  misc_feature: HIJSMM301DEW4S.2.76.G10.1.454.light.4.raw
acgctcgacacacgaccggtgctcgatttagtcactcatacagggtcctgggcccagtctgtgctgactcagccaccctcagcgtctggggcccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 591058 - DNA, 373 bp, Homo sapiens
  misc_feature: HIJSMM301EUDZ0.19.60.F05.1.454.light.4.raw
tactctcgtgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacacgagagta

SEQ ID NO: 591059 - DNA, 498 bp, Homo sapiens
  misc_feature: HIJSMM301DVZRK.46.26.C04.1.454.light.4.raw
actagcagtacacgaccggtgctcgatttagtctagcgactttgggttttgggggtgatcaggactcctcagttcaccttctcacaatgaggctccctgctcagctcctggggctgctaatgctctgggtctctggatccagtggggatattgtgatgactcatcgggggggggtccactctcccctgccccgtcaccccctggagagccggcctccatctcctgcaggtctagtcagagcctcctgcatagtaatggagacaactattttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 591060 - DNA, 483 bp, Homo sapiens; identical to SEQ ID NO: 547837
  misc_feature: HIJSMM301DVS40.48.40.D07.1.454.light.4.raw

SEQ ID NO: 591061 - DNA, 487 bp, Homo sapiens; identical to SEQ ID NO: 535583
  misc_feature: HIJSMM301CMLQ4.22.73.G07.1.454.light.4.raw

SEQ ID NO: 591062 - DNA, 504 bp, Homo sapiens; identical to SEQ ID NO: 538940
  misc_feature: HIJSMM301B6021.2.35.D02.1.454.light.4.raw

SEQ ID NO: 591063 - DNA, 441 bp, Homo sapiens; identical to SEQ ID NO: 550529
  misc_feature: HIJSMM301B8PSX.41.9.A09.1.454.light.4.raw

SEQ ID NO: 591064 - DNA, 478 bp, Homo sapiens; identical to SEQ ID NO: 535129
  misc_feature: HIJSMM301CD3MW.11.11.A11.1.454.light.4.raw

SEQ ID NO: 591065 - DNA, 520 bp, Homo sapiens; identical to SEQ ID NO: 558881
  misc_feature: HIJSMM301CYAAL.27.23.C01.1.454.light.4.raw
  modified_base (516)..(516): a, c, t, g, unknown or other

SEQ ID NO: 591066 - DNA, 498 bp, Homo sapiens
  misc_feature: HIJSMM301ATVIX.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcagcagcctgcagcctgatgattttgcaacttattactgccaacattataatacttattcgtacacttttggccagggaccaagctggagatcaaacgaactgtggctgcaccatctgtcttcatcttccccg

SEQ ID NO: 591067 - DNA, 511 bp, Homo sapiens; identical to SEQ ID NO: 549861
  misc_feature: HIJSMM301APOYD.19.59.F04.1.454.light.4.raw

SEQ ID NO: 591068 - DNA, 482 bp, Homo sapiens; identical to SEQ ID NO: 540521
  misc_feature: HIJSMM301DI9IJ.21.25.C03.1.454.light.4.raw

SEQ ID NO: 591069 - DNA, 484 bp, Homo sapiens; identical to SEQ ID NO: 535441
  misc_feature: HIJSMM301AT4MT.26.60.F05.1.454.light.4.raw

SEQ ID NO: 591070 - DNA, 454 bp, Homo sapiens; identical to SEQ ID NO: 535005
  misc_feature: HIJSMM301DM55F.19.86.H09.1.454.light.4.raw

SEQ ID NO: 591071 - DNA, 499 bp, Homo sapiens
  misc_feature: HIJSMM301EKUI7.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaacgggaccacgggtggaaatacaaacgaaactgtggctgcaccatctgtcttcatt

SEQ ID NO: 591072 - DNA, 454 bp, Homo sapiens; identical to SEQ ID NO: 534964
  misc_feature: HIJSMM301EBMM0.19.86.H09.1.454.light.4.raw

SEQ ID NO: 591073 - DNA, 507 bp, Homo sapiens; identical to SEQ ID NO: 544788
  misc_feature: HIJSMM301CFH8W.16.46.E02.1.454.light.4.raw

SEQ ID NO: 591074 - DNA, 478 bp, Homo sapiens; identical to SEQ ID NO: 545131
  misc_feature: HIJSMM301C3KQG.5.52.E08.1.454.light.4.raw

SEQ ID NO: 591075 - DNA, 486 bp, Homo sapiens; identical to SEQ ID NO: 535385
  misc_feature: HIJSMM301A5KYJ.19.71.G05.1.454.light.4.raw

SEQ ID NO: 591076 - DNA, 473 bp, Homo sapiens; identical to SEQ ID NO: 576605
  misc_feature: HIJSMM301EE8DK.7.81.H04.1.454.light.4.raw

SEQ ID NO: 591077 - DNA, 502 bp, Homo sapiens; identical to SEQ ID NO: 543132
  misc_feature: HIJSMM301B8BL1.17.28.C06.1.454.light.4.raw

SEQ ID NO: 591078 - DNA, 488 bp, Homo sapiens; identical to SEQ ID NO: 535125
  misc_feature: HIJSMM301B558Q.17.25.C03.1.454.light.4.raw

SEQ ID NO: 591079 - DNA, 481 bp, Homo sapiens
  misc_feature: HIJSMM301DOA0U.41.15.B04.1.454.light.4.raw
tctatactatcacgaccggtgctcgatttagacagtatatatccgcgggcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatccattgggtgttcggcggagggaccaaactgaccgtcctgggtcagcccaaggctgccccctcggtcactctgttcccgccctcctcatagtataga

SEQ ID NO: 591080 - DNA, 497 bp, Homo sapiens; identical to SEQ ID NO: 567241
  misc_feature: HIJSMM301AL9Y6.11.59.F04.1.454.light.4.raw

SEQ ID NO: 591081 - DNA, 513 bp, Homo sapiens
  misc_feature: HIJSMM301DXNWJ.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaaccccactgtcactctcg

SEQ ID NO: 591082 - DNA, 464 bp, Homo sapiens
  misc_feature: HIJSMM301CMYCN.11.70.G04.1.454.light.4.raw
  modified_base (403)..(403): a, c, t, g, unknown or other
  modified_base (431)..(431): a, c, t, g, unknown or other
cgagagataccacgaccggtgctcgatttagtgtagtgtgaagggaaagggggcagaagtctcgctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcagggtcccatctcgattcagtggcagtggatctgggacagatttcactctcaccatcagcagcctgcagcctgaagatgttgcaacttnttactgtcaaaagatagcgctgccccgntcagtttcggcggagggccaaggtggagatacg

SEQ ID NO: 591083 - DNA, 506 bp, Homo sapiens
  misc_feature: HIJSMM301DSLH4.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcact

SEQ ID NO: 591084 - DNA, 520 bp, Homo sapiens; identical to SEQ ID NO: 543171
  misc_feature: HIJSMM301DWHKC.48.24.C02.1.454.light.4.raw

SEQ ID NO: 591085 - DNA, 492 bp, Homo sapiens; identical to SEQ ID NO: 535126
  misc_feature: HIJSMM301B7J2K.18.11.A11.1.454.light.4.raw

SEQ ID NO: 591086 - DNA, 481 bp, Homo sapiens
  misc_feature: HIJSMM301BY1AN.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttgggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccaccctcctccgtgtctgat

SEQ ID NO: 591087 - DNA, 503 bp, Homo sapiens; identical to SEQ ID NO: 539976
  misc_feature: HIJSMM301AYY71.47.55.E11.1.454.light.4.raw

SEQ ID NO: 591088 - DNA, 481 bp, Homo sapiens; identical to SEQ ID NO: 535993
  misc_feature: HIJSMM301DDHSR.21.25.C03.1.454.light.4.raw

SEQ ID NO: 591089 - DNA, 483 bp, Homo sapiens
  misc_feature: HIJSMM301B9XH8.4.41.D08.1.454.light.4.raw
agcactgtagcacgaccggtgctcgatttagtcacgcgagaaagggaaaggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccat

SEQ ID NO: 591090 - DNA, 521 bp, Homo sapiens; identical to SEQ ID NO: 539470
  misc_feature: HIJSMM301A03BL.27.23.C01.1.454.light.4.raw

SEQ ID NO: 591091 - DNA, 514 bp, Homo sapiens; identical to SEQ ID NO: 543870
  misc_feature: HIJSMM301EPHP6.40.12.B01.1.454.light.4.raw

SEQ ID NO: 591092 - DNA, 504 bp, Homo sapiens
  misc_feature: HIJSMM301B2YV1.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggcccaagggacacgactggagattaaaacg

SEQ ID NO: 591093 - DNA, 509 bp, Homo sapiens
  misc_feature: HIJSMM301DPBF8.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactagtggctgcaccatctgtcttcta

SEQ ID NO: 591094 - DNA, 483 bp, Homo sapiens; identical to SEQ ID NO: 545057
  misc_feature: HIJSMM301B5Q3W.48.37.D04.1.454.light.4.raw

SEQ ID NO: 591095 - DNA, 503 bp, Homo sapiens; identical to SEQ ID NO: 572925
  misc_feature: HIJSMM301EVP21.14.57.F02.1.454.light.4.raw

SEQ ID NO: 591096 - DNA, 521 bp, Homo sapiens; identical to SEQ ID NO: 539470
  misc_feature: HIJSMM301BRR5D.27.23.C01.1.454.light.4.raw

SEQ ID NO: 591097 - DNA, 486 bp, Homo sapiens; identical to SEQ ID NO: 535290
  misc_feature: HIJSMM301ELDPW.3.12.B01.1.454.light.4.raw

SEQ ID NO: 591098 - DNA, 521 bp, Homo sapiens; identical to SEQ ID NO: 538715
  misc_feature: HIJSMM301CIY2F.27.23.C01.1.454.light.4.raw

SEQ ID NO: 591099 - DNA, 489 bp, Homo sapiens; identical to SEQ ID NO: 540424
  misc_feature: HIJSMM301EQOVK.17.25.C03.1.454.light.4.raw

SEQ ID NO: 591100 - DNA, 448 bp, Homo sapiens; identical to SEQ ID NO: 561199
  misc_feature: HIJSMM301CW3XH.18.9.A09.1.454.light.4.raw

SEQ ID NO: 591101 - DNA, 475 bp, Homo sapiens
  misc_feature: HIJSMM301DE8UV.49.52.E08.1.454.light.4.raw
agtcgagagacacgaccggtgctcgatttagtcgagctctcagagagaaaggggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacatttttggcctaggggaccaagttggagagtaacaaacgaa

SEQ ID NO: 591102 - DNA, 484 bp, Homo sapiens; identical to SEQ ID NO: 536162
  misc_feature: HIJSMM301C4KYX.13.59.F04.1.454.light.4.raw

SEQ ID NO: 591103 - DNA, 499 bp, Homo sapiens
  misc_feature: HIJSMM301B7A0U.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgtcggtccaaggaccgaacggtaggacgagtcaaacgaactacgtggcgtgcgaccatctgtctt

SEQ ID NO: 591104 - DNA, 444 bp, Homo sapiens; identical to SEQ ID NO: 535027
  misc_feature: HIJSMM301EPXXV.8.73.G07.1.454.light.4.raw

SEQ ID NO: 591105 - DNA, 495 bp, Homo sapiens; identical to SEQ ID NO: 535486
  misc_feature: HIJSMM301ANS39.26.72.G06.1.454.light.4.raw

SEQ ID NO: 591106 - DNA, 500 bp, Homo sapiens; identical to SEQ ID NO: 539795
  misc_feature: HIJSMM301DE6T7.22.38.D05.1.454.light.4.raw

SEQ ID NO: 591107 - DNA, 499 bp, Homo sapiens; identical to SEQ ID NO: 537857
  misc_feature: HIJSMM301DX1DP.52.34.D01.1.454.light.4.raw

SEQ ID NO: 591108 - DNA, 519 bp, Homo sapiens
  misc_feature: HIJSMM301AR6PK.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttctatcttccccg

SEQ ID NO: 591109 - DNA, 506 bp, Homo sapiens; identical to SEQ ID NO: 568653
  misc_feature: HIJSMM301ENSTZ.8.34.D01.1.454.light.4.raw

SEQ ID NO: 591110 - DNA, 486 bp, Homo sapiens; identical to SEQ ID NO: 537144
  misc_feature: HIJSMM301BYM0X.46.35.D02.1.454.light.4.raw

SEQ ID NO: 591111 - DNA, 494 bp, Homo sapiens; identical to SEQ ID NO: 534992
  misc_feature: HIJSMM301CFAOQ.9.1.A01.1.454.light.4.raw

SEQ ID NO: 591112 - DNA, 484 bp, Homo sapiens
  misc_feature: HIJSMM301CB1QW.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtcctggtcagccaaggctgcccccg

SEQ ID NO: 591113 - DNA, 495 bp, Homo sapiens; identical to SEQ ID NO: 543094
  misc_feature: HIJSMM301DIQ3P.22.57.F02.1.454.light.4.raw

SEQ ID NO: 591114 - DNA, 494 bp, Homo sapiens; identical to SEQ ID NO: 534994
  misc_feature: HIJSMM301A3IWC.27.78.H01.1.454.light.4.raw

SEQ ID NO: 591115 - DNA, 523 bp, Homo sapiens
  misc_feature: HIJSMM301ENAVE.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccatggttgcaccgcaaagcgggacccagaccctggagcctcagttggaagtagccgatccagcctgcggagcctgtggggcaggtcagcccaaggcccaacccactcgtcactctgttcccccg

SEQ ID NO: 591116 - DNA, 506 bp, Homo sapiens; identical to SEQ ID NO: 543993
  misc_feature: HIJSMM301ESXDK.18.78.H01.1.454.light.4.raw

SEQ ID NO: 591117 - DNA, 467 bp, Homo sapiens; identical to SEQ ID NO: 538403
  misc_feature: HIJSMM301ARFJG.41.48.E04.1.454.light.4.raw

SEQ ID NO: 591118 - DNA, 497 bp, Homo sapiens
  misc_feature: HIJSMM301COO9Y.48.38.D05.1.454.light.4.raw
agtatacatacacgaccggtgctcgatttagtatctgatagttgggtttgggggctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccgggtccctgaccgattcagtggcagcgggtctgggacacatttcgctttcaccatcagcagcctgcaggctgaggatgtggcagtttattactgtcagcaatattatactactccgtggacttttcggccaagggaccaaggtggaaatcagacgaactgtggctgcacc

SEQ ID NO: 591119 - DNA, 487 bp, Homo sapiens; identical to SEQ ID NO: 540958
  misc_feature: HIJSMM301D5NK4.48.77.G11.1.454.light.4.raw

SEQ ID NO: 591120 - DNA, 512 bp, Homo sapiens; identical to SEQ ID NO: 581887
  misc_feature: HIJSMM301EEN9Q.17.33.C11.1.454.light.4.raw

SEQ ID NO: 591121 - DNA, 514 bp, Homo sapiens; identical to SEQ ID NO: 538885
  misc_feature: HIJSMM301DCTGN.14.19.B08.1.454.light.4.raw

SEQ ID NO: 591122 - DNA, 490 bp, Homo sapiens
  misc_feature: HIJSMM301A6AD8.19.57.F02.1.454.light.4.raw
tactctcgtgcacgaccggtgctcgatttagctcgatatagttgggtttgggggatcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcacttttcggcggaggaccaaggtggagatcaagcgaactgtggctgcaccatctgtctt

SEQ ID NO: 591123 - DNA, 496 bp, Homo sapiens
  misc_feature: HIJSMM301CWT04.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccgagggtggagatacaaacgaactgtggctgcaccactctgtcttcta

SEQ ID NO: 591124 - DNA, 488 bp, Homo sapiens; identical to SEQ ID NO: 542699
  misc_feature: HIJSMM301CXGRO.12.51.E07.1.454.light.4.raw

SEQ ID NO: 591125 - DNA, 465 bp, Homo sapiens
  misc_feature: HIJSMM301B5WCB.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 591126 - DNA, 460 bp, Homo sapiens; identical to SEQ ID NO: 536053
  misc_feature: HIJSMM301CB86P.22.28.C06.1.454.light.4.raw

SEQ ID NO: 591127 - DNA, 513 bp, Homo sapiens
  misc_feature: HIJSMM301AY7RL.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttctaccatcagcggcctgcagcctgaagatattgcaacatattactgtcaacagtatggtaatactcccacctcacctttcggtcggacgggaccgaaggtacgtaggatacaaaccgaaactacgtggtcgtgtcgacccaactccttgtccttt

SEQ ID NO: 591128 - DNA, 498 bp, Homo sapiens; identical to SEQ ID NO: 547944
  misc_feature: HIJSMM301CU1BO.41.53.E09.1.454.light.4.raw

SEQ ID NO: 591129 - DNA, 515 bp, Homo sapiens
  misc_feature: HIJSMM301BI4EX.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggaggaccaagctgaccgtcctaggtcagcccaagctgccccctcggtcact

SEQ ID NO: 591130 - DNA, 454 bp, Homo sapiens; identical to SEQ ID NO: 534964
  misc_feature: HIJSMM301C05VI.19.86.H09.1.454.light.4.raw

SEQ ID NO: 591131 - DNA, 487 bp, Homo sapiens
  misc_feature: HIJSMM301CQA3I.48.53.E09.1.454.light.4.raw
agtatacatacacgaccggtgctcgatttagagagagtgtgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtgagatcaaacgaactgtgctgcaa

SEQ ID NO: 591132 - DNA, 487 bp, Homo sapiens; identical to SEQ ID NO: 545751
  misc_feature: HIJSMM301ELX9B.46.35.D02.1.454.light.4.raw

SEQ ID NO: 591133 - DNA, 449 bp, Homo sapiens; identical to SEQ ID NO: 561280
  misc_feature: HIJSMM301CWOSY.11.86.H09.1.454.light.4.raw

SEQ ID NO: 591134 - DNA, 486 bp, Homo sapiens; identical to SEQ ID NO: 563598
  misc_feature: HIJSMM301DNAA2.14.53.E09.1.454.light.4.raw

SEQ ID NO: 591135 - DNA, 508 bp, Homo sapiens
  misc_feature: HIJSMM301AOHKV.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactagtggctgcaccactctgtctt

SEQ ID NO: 591136 - DNA, 491 bp, Homo sapiens
  misc_feature: HIJSMM301BY8FB.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 591137 - DNA, 493 bp, Homo sapiens
  misc_feature: HIJSMM301DSKMM.5.55.E11.1.454.light.4.raw
atcagacacgcacgaccggtgctcgatttagcactcgcacgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttatactgtcagcaatattttattactcctctgacgttcggccaagggaccaaggtgaaatcaaacgaactgtggctgca

SEQ ID NO: 591138 - DNA, 496 bp, Homo sapiens; identical to SEQ ID NO: 535109
  misc_feature: HIJSMM301D70WF.16.78.H01.1.454.light.4.raw

SEQ ID NO: 591139 - DNA, 485 bp, Homo sapiens; identical to SEQ ID NO: 535606
  misc_feature: HIJSMM301EOQ2C.47.46.E02.1.454.light.4.raw

SEQ ID NO: 591140 - DNA, 495 bp, Homo sapiens; identical to SEQ ID NO: 538359
  misc_feature: HIJSMM301A719R.11.59.F04.1.454.light.4.raw

SEQ ID NO: 591141 - DNA, 505 bp, Homo sapiens
  misc_feature: HIJSMM301ATEKT.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgctagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcca

SEQ ID NO: 591142 - DNA, 480 bp, Homo sapiens; identical to SEQ ID NO: 535291
  misc_feature: HIJSMM301DYSNS.22.59.F04.1.454.light.4.raw

SEQ ID NO: 591143 - DNA, 488 bp, Homo sapiens; identical to SEQ ID NO: 546278
  misc_feature: HIJSMM301BAVHX.43.33.C11.1.454.light.4.raw
  modified_base (364)..(364): a, c, t, g, unknown or other

SEQ ID NO: 591144 - DNA, 489 bp, Homo sapiens
  misc_feature: HIJSMM301B8P87.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggactaacacgtttccctccgaccttcggccaagggacacgactcggagtaattaaacgaactagtggctga

SEQ ID NO: 591145 - DNA, 517 bp, Homo sapiens
  misc_feature: HIJSMM301ADGAD.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccactct

SEQ ID NO: 591146 - DNA, 522 bp, Homo sapiens
  misc_feature: HIJSMM301BFPIQ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 591147 - DNA, 504 bp, Homo sapiens
  misc_feature: HIJSMM301CP0GS.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaacctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctgccccccg

SEQ ID NO: 591148 - DNA, 441 bp, Homo sapiens; identical to SEQ ID NO: 534971
  misc_feature: HIJSMM301DYDV9.11.3.A03.1.454.light.4.raw

SEQ ID NO: 591149 - DNA, 511 bp, Homo sapiens
  misc_feature: HIJSMM301BZKOK.47.55.E11.1.454.light.4.raw
  modified_base (493)..(493): a, c, t, g, unknown or other
agctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccnctgtcactctgttccccg

SEQ ID NO: 591150 - DNA, 500 bp, Homo sapiens
  misc_feature: HIJSMM301BIJPF.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctcctgaccatctctgggctccaggctgatgacgaggctgattattactgcaggtcatatacaatcagcaacacttatgtcttcgggactgggaccaagatcaccgtctaggtcagcccaaggccaacccactgtcta

SEQ ID NO: 591151 - DNA, 518 bp, Homo sapiens
  misc_feature: HIJSMM301BYYNI.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgcccctcggtcactctgttcccacct

SEQ ID NO: 591152 - DNA, 501 bp, Homo sapiens; identical to SEQ ID NO: 574260
  misc_feature: HIJSMM301DK29H.41.67.G01.1.454.light.4.raw

SEQ ID NO: 591153 - DNA, 507 bp, Homo sapiens; identical to SEQ ID NO: 545328
  misc_feature: HIJSMM301EAENM.8.33.C11.1.454.light.4.raw

SEQ ID NO: 591154 - DNA, 518 bp, Homo sapiens; identical to SEQ ID NO: 563314
  misc_feature: HIJSMM301DO60W.14.70.G04.1.454.light.4.raw

SEQ ID NO: 591155 - DNA, 489 bp, Homo sapiens; identical to SEQ ID NO: 535139
  misc_feature: HIJSMM301DOLWU.14.55.E11.1.454.light.4.raw

SEQ ID NO: 591156 - DNA, 508 bp, Homo sapiens
  misc_feature: HIJSMM301BERU3.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctcgccccctcggtcactctcgttcccgcct

SEQ ID NO: 591157 - DNA, 505 bp, Homo sapiens; identical to SEQ ID NO: 536117
  misc_feature: HIJSMM301B4BGH.8.71.G05.1.454.light.4.raw

SEQ ID NO: 591158 - DNA, 502 bp, Homo sapiens; identical to SEQ ID NO: 537816
  misc_feature: HIJSMM301ALRR3.19.78.H01.1.454.light.4.raw

SEQ ID NO: 591159 - DNA, 484 bp, Homo sapiens
  misc_feature: HIJSMM301D2MQQ.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaagtggatatcagacgaa

SEQ ID NO: 591160 - DNA, 505 bp, Homo sapiens
  misc_feature: HIJSMM301BULFR.48.41.D08.1.454.light.4.raw
agtatacatacacgaccggtgctcgatttagtcacgcgagaaagggaaaggggagagctgctcagttaggacccagagggaaccatggaaaccccagcgcagcttctcttcctcctgctactctggctcccagataccgccggagaaattttgttgacgcagtctccaggcaccctgtctttgtctccaggggaaagagccaccctctcctgcagggccagtcagtatgttagcagcaactacttagcctggtaccagcagaaacctggccaggctcccaggctcctcatctacggtgcatccagcagggccattggcatcccagacaggttcagtggcagtgggtctgggacaaacttcactctcaccatcagcagactggagcctgaagattttgcagtctattactgtcagcagtatactaactcacctaagacgttcggccaagggaccaaggtggaaatcaaacgaactagtggctgcaccatctgtcttcatcttcccg

SEQ ID NO: 591161 - DNA, 505 bp, Homo sapiens
  misc_feature: HIJSMM301D0EXW.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttc

SEQ ID NO: 591162 - DNA, 497 bp, Homo sapiens; identical to SEQ ID NO: 535664
  misc_feature: HIJSMM301CYS8O.22.14.B03.1.454.light.4.raw

SEQ ID NO: 591163 - DNA, 493 bp, Homo sapiens; identical to SEQ ID NO: 544335
  misc_feature: HIJSMM301CQWMQ.5.57.F02.1.454.light.4.raw

SEQ ID NO: 591164 - DNA, 484 bp, Homo sapiens
  misc_feature: HIJSMM301B40J3.46.26.C04.1.454.light.4.raw
actagcagtacacgaccggtgctcgatttagtctagcgactttgggtttggggtgatcagaactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 591165 - DNA, 496 bp, Homo sapiens
  misc_feature: HIJSMM301C4DRU.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtctaggtcagcccaagg

SEQ ID NO: 591166 - DNA, 445 bp, Homo sapiens
  misc_feature: HIJSMM301ASUMC.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccggggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 591167 - DNA, 463 bp, Homo sapiens; identical to SEQ ID NO: 535062
  misc_feature: HIJSMM301BEQVS.11.73.G07.1.454.light.4.raw

SEQ ID NO: 591168 - DNA, 505 bp, Homo sapiens; identical to SEQ ID NO: 535987
  misc_feature: HIJSMM301DPAL6.18.37.D04.1.454.light.4.raw

SEQ ID NO: 591169 - DNA, 498 bp, Homo sapiens; identical to SEQ ID NO: 550958
  misc_feature: HIJSMM301AZCHT.48.33.C11.1.454.light.4.raw

SEQ ID NO: 591170 - DNA, 529 bp, Homo sapiens
  misc_feature: HIJSMM301EYW5H.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactggaccaaggtcaccgtcctaggtcagcccaaggcccaaaccccacctagtcactctcgttcccgacccctccctcccgtcgtc

SEQ ID NO: 591171 - DNA, 514 bp, Homo sapiens; identical to SEQ ID NO: 544242
  misc_feature: HIJSMM301CS1YB.43.23.C01.1.454.light.4.raw

SEQ ID NO: 591172 - DNA, 475 bp, Homo sapiens; identical to SEQ ID NO: 548160
  misc_feature: HIJSMM301EKHA0.52.1.A01.1.454.light.4.raw

SEQ ID NO: 591173 - DNA, 490 bp, Homo sapiens; identical to SEQ ID NO: 535234
  misc_feature: HIJSMM301CZ1EY.17.21.B10.1.454.light.4.raw

SEQ ID NO: 591174 - DNA, 485 bp, Homo sapiens; identical to SEQ ID NO: 547003
  misc_feature: HIJSMM301AIJP3.40.83.H06.1.454.light.4.raw

SEQ ID NO: 591175 - DNA, 479 bp, Homo sapiens; identical to SEQ ID NO: 583430
  misc_feature: HIJSMM301AMJAL.4.10.A10.1.454.light.4.raw

SEQ ID NO: 591176 - DNA, 515 bp, Homo sapiens
  misc_feature: HIJSMM301C2QFM.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaaggctgaccgtcttaagtcagcccaaggctcgccccctcggtcactctgttcccgccctcct

SEQ ID NO: 591177 - DNA, 510 bp, Homo sapiens; identical to SEQ ID NO: 535855
  misc_feature: HIJSMM301AL213.17.33.C11.1.454.light.4.raw

SEQ ID NO: 591178 - DNA, 520 bp, Homo sapiens
  misc_feature: HIJSMM301A43U6.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggtgcaccgcaaagcgggacccagaccctggagcctcagttggaagcagccgatccagcctgcggagccgtgtggggcaggtcagcccaaggcctcgccccctcggtcactctcgttcccgccctcctccacg

SEQ ID NO: 591179 - DNA, 496 bp, Homo sapiens
  misc_feature: HIJSMM301ADSC7.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcggccaggaccgaacggtggaaggtacgaaacgaactagtggtcgtgcaccatctgtctt

SEQ ID NO: 591180 - DNA, 510 bp, Homo sapiens; identical to SEQ ID NO: 575037
  misc_feature: HIJSMM301CTV6N.8.42.D09.1.454.light.4.raw

SEQ ID NO: 591181 - DNA, 485 bp, Homo sapiens
  misc_feature: HIJSMM301BXHZ8.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccaggggtggaggatcagacgaa

SEQ ID NO: 591182 - DNA, 496 bp, Homo sapiens
  misc_feature: HIJSMM301BMLVC.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaaggaccgaaggtggaagtcaaacgaactagtggctgcaccatctgtcttctatcttcccg

SEQ ID NO: 591183 - DNA, 483 bp, Homo sapiens; identical to SEQ ID NO: 536697
  misc_feature: HIJSMM301C23RH.46.26.C04.1.454.light.4.raw

SEQ ID NO: 591184 - DNA, 490 bp, Homo sapiens
  misc_feature: HIJSMM301CB12V.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagacttttgcaacttactactgtcaacagagttacagtacccccctcactttcggcggagggaccaaggcggagatcagacgaactgtggctgcaccatctgtcttcta

SEQ ID NO: 591185 - DNA, 509 bp, Homo sapiens
  misc_feature: HIJSMM301DNNIY.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcgaagcgaactgtggctgcaccatctgtcttcatcttcccgcc

SEQ ID NO: 591186 - DNA, 486 bp, Homo sapiens; identical to SEQ ID NO: 543923
  misc_feature: HIJSMM301A4FHX.3.88.H11.1.454.light.4.raw

SEQ ID NO: 591187 - DNA, 491 bp, Homo sapiens; identical to SEQ ID NO: 536211
  misc_feature: HIJSMM301DRYH9.16.53.E09.1.454.light.4.raw

SEQ ID NO: 591188 - DNA, 490 bp, Homo sapiens; identical to SEQ ID NO: 544667
  misc_feature: HIJSMM301ECK9O.12.23.C01.1.454.light.4.raw

SEQ ID NO: 591189 - DNA, 491 bp, Homo sapiens
  misc_feature: HIJSMM301D9FDX.41.67.G01.1.454.light.4.raw
tctatactatcacgaccggtgctcgatttagagtatacatattgggtttgggggagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaaggggacgggatccctgatcgcttctcaggctccagctctggggctgagcgctacctttcgatctccagcctccagtctgaggatgaggctgactattactgtcagtcctgggacaggggcgttttggtgttcgggcggagggaccagactgaccgtctgggtcagcccaaggctgccccctggt

SEQ ID NO: 591190 - DNA, 477 bp, Homo sapiens
  misc_feature: HIJSMM301CE45B.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttgctgttcggcggcggac

SEQ ID NO: 591191 - DNA, 486 bp, Homo sapiens
  misc_feature: HIJSMM301CYX8D.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttatactgtctccagtatgatgcttaccctcggactttcggccaaggaccgaacggtaggaaatacaaacgaactagtggctgcacca

SEQ ID NO: 591192 - DNA, 505 bp, Homo sapiens
  misc_feature: HIJSMM301EGPD5.8.28.C06.1.454.light.4.raw
ctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttc

SEQ ID NO: 591193 - DNA, 519 bp, Homo sapiens; identical to SEQ ID NO: 541143
  misc_feature: HIJSMM301D0ZBM.7.86.H09.1.454.light.4.raw

SEQ ID NO: 591194 - DNA, 503 bp, Homo sapiens
  misc_feature: HIJSMM301C9PWU.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctagtcagcccaaggctgcccccc

SEQ ID NO: 591195 - DNA, 502 bp, Homo sapiens
  misc_feature: HIJSMM301CUGH9.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggt

SEQ ID NO: 591196 - DNA, 490 bp, Homo sapiens; identical to SEQ ID NO: 562759
  misc_feature: HIJSMM301AQETG.19.71.G05.1.454.light.4.raw

SEQ ID NO: 591197 - DNA, 476 bp, Homo sapiens; identical to SEQ ID NO: 581072
  misc_feature: HIJSMM301BESAF.13.11.A11.1.454.light.4.raw

SEQ ID NO: 591198 - DNA, 494 bp, Homo sapiens
  misc_feature: HIJSMM301C9T9V.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgt

SEQ ID NO: 591199 - DNA, 481 bp, Homo sapiens
  misc_feature: HIJSMM301CS72X.51.34.D01.1.454.light.4.raw
cgatcgtatacacgaccggtgctcgatttagatcgtctgtgttgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcgggggaccgaagggtggagatcaagcgaactgtggctgcaccatctgtt

SEQ ID NO: 591200 - DNA, 496 bp, Homo sapiens; identical to SEQ ID NO: 536248
  misc_feature: HIJSMM301CGET6.22.27.C05.1.454.light.4.raw

SEQ ID NO: 591201 - DNA, 489 bp, Homo sapiens; identical to SEQ ID NO: 554345
  misc_feature: HIJSMM301EHEYV.3.67.G01.1.454.light.4.raw

SEQ ID NO: 591202 - DNA, 491 bp, Homo sapiens; identical to SEQ ID NO: 536211
  misc_feature: HIJSMM301CZN0X.16.53.E09.1.454.light.4.raw

SEQ ID NO: 591203 - DNA, 445 bp, Homo sapiens; identical to SEQ ID NO: 567502
  misc_feature: HIJSMM301AKCT8.5.9.A09.1.454.light.4.raw

SEQ ID NO: 591204 - DNA, 476 bp, Homo sapiens
  misc_feature: HIJSMM301BFGV8.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaggtcaccgtcctaagtcagacccg

SEQ ID NO: 591205 - DNA, 495 bp, Homo sapiens
  misc_feature: HIJSMM301DB1BG.48.4.A04.1.454.light.4.raw
agtatacatacacgaccggtgctcgatttagagtagtgatcaggggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaacgaactgtggctgcaccatctgtcttcatcttccccg

SEQ ID NO: 591206 - DNA, 493 bp, Homo sapiens; identical to SEQ ID NO: 535084
  misc_feature: HIJSMM301DH3JT.47.64.F09.1.454.light.4.raw

SEQ ID NO: 591207 - DNA, 488 bp, Homo sapiens
  misc_feature: HIJSMM301DSL5N.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggtccaggggaccaagctggagatcaaacgaaactgtggctgcaccat

SEQ ID NO: 591208 - DNA, 486 bp, Homo sapiens; identical to SEQ ID NO: 535043
  misc_feature: HIJSMM301EHBY5.46.35.D02.1.454.light.4.raw

SEQ ID NO: 591209 - DNA, 494 bp, Homo sapiens
  misc_feature: HIJSMM301E3UYG.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgtcgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 591210 - DNA, 504 bp, Homo sapiens; identical to SEQ ID NO: 542411
  misc_feature: HIJSMM301D47NH.9.53.E09.1.454.light.4.raw

SEQ ID NO: 591211 - DNA, 482 bp, Homo sapiens
  misc_feature: HIJSMM301B8PO9.16.81.H04.1.454.light.4.raw
tgtactactccacgaccggtgctcgatttagtagtgtagattcgcgggggactcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgtt

SEQ ID NO: 591212 - DNA, 497 bp, Homo sapiens
  misc_feature: HIJSMM301ARUPF.48.28.C06.1.454.light.4.raw
agtatacatacacgaccggtgctcgatttagagctcacgtattgggtttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 591213 - DNA, 481 bp, Homo sapiens; identical to SEQ ID NO: 535993
  misc_feature: HIJSMM301EFLMH.21.25.C03.1.454.light.4.raw

SEQ ID NO: 591214 - DNA, 486 bp, Homo sapiens; identical to SEQ ID NO: 535385
  misc_feature: HIJSMM301AMVOE.19.71.G05.1.454.light.4.raw

SEQ ID NO: 591215 - DNA, 497 bp, Homo sapiens; identical to SEQ ID NO: 545672
  misc_feature: HIJSMM301DS2ZH.2.49.E05.1.454.light.4.raw

SEQ ID NO: 591216 - DNA, 481 bp, Homo sapiens
  misc_feature: HIJSMM301CM61K.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgctaacttattactgtcaacaggtttatatttaccctcgtattttcggcccttgggaccacagtagatatcaaacgaactgtggctgcacc

SEQ ID NO: 591217 - DNA, 516 bp, Homo sapiens
  misc_feature: HIJSMM301D07KP.14.78.H01.1.454.light.4.raw
cgtctagtaccacgaccggtgctcgatttagtgtgagtagtttgggtttggggggggtcgacaagaggcagcgctctcgggacggtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggcctgccccctcggtcactctgtt

SEQ ID NO: 591218 - DNA, 490 bp, Homo sapiens
  misc_feature: HIJSMM301DU6RA.5.28.C06.1.454.light.4.raw
atcagacacgcacgaccggtgctcgatttagagctcacgtattgggtttggggactttccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaaggtggagatcgaacgaactacgtggcgtgcgaccaactctgtcgtttctactcttcccgtcccactctcgacgt

SEQ ID NO: 591219 - DNA, 486 bp, Homo sapiens
  misc_feature: HIJSMM301C5J94.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggaggaccaaggtcgagatcaaacgaactgtggctgcaccatctgtctt

SEQ ID NO: 591220 - DNA, 485 bp, Homo sapiens
  misc_feature: HIJSMM301AFX1Y.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgatgcatccaatttggaaagtggggtcccatcaaggttcagtggcagtggatctgggacagatttcactctcaccatcagcagtgtgcgacctgaagattttgcaacttactaactgtcaacagagttacagtacccctcagctcactttcggcggagggaccaaaggtggagatcaaacgaactgtggctgca

SEQ ID NO: 591221 - DNA, 487 bp, Homo sapiens; identical to SEQ ID NO: 541444
  misc_feature: HIJSMM301BQS0A.19.71.G05.1.454.light.4.raw

SEQ ID NO: 591222 - DNA, 480 bp, Homo sapiens; identical to SEQ ID NO: 577324
  misc_feature: HIJSMM301B3H0G.52.4.A04.1.454.light.4.raw

SEQ ID NO: 591223 - DNA, 489 bp, Homo sapiens
  misc_feature: HIJSMM301EA6IM.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttatactgtcagcagtataataactggcctcagacttggcggaggaccaaggtgggatacaaacgaactgtggctgcaccatctgtctt

SEQ ID NO: 591224 - DNA, 446 bp, Homo sapiens
  misc_feature: HIJSMM301ALFG5.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctccctccactacctatg

SEQ ID NO: 591225 - DNA, 503 bp, Homo sapiens
  misc_feature: HIJSMM301ATQBX.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttacgtttcggcggagggaccgaaggtggagatacaaacgaaactgtggctgcaccatctgtcttcatcttccccg

SEQ ID NO: 591226 - DNA, 517 bp, Homo sapiens
  misc_feature: HIJSMM301EX857.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtcttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaaggtaggaagtacgaaacgaactagtggctcgcaccactctcgtcttcatcttcccgtccact

SEQ ID NO: 591227 - DNA, 501 bp, Homo sapiens
  misc_feature: HIJSMM301A9SKQ.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccgaaactgaccgtcctaggtcagcccaaggctgtccccccg

SEQ ID NO: 591228 - DNA, 491 bp, Homo sapiens; identical to SEQ ID NO: 538388
  misc_feature: HIJSMM301BQDKL.51.81.H04.1.454.light.4.raw

SEQ ID NO: 591229 - DNA, 440 bp, Homo sapiens; identical to SEQ ID NO: 550374
  misc_feature: HIJSMM301B2NHL.41.9.A09.1.454.light.4.raw

SEQ ID NO: 591230 - DNA, 499 bp, Homo sapiens
  misc_feature: HIJSMM301ECA05.48.44.D11.1.454.light.4.raw
agtatacatacacgaccggtgctcgatttagcgcagtacgaagggtttggggccaaaggatgggagggggtcaggctggaactgaggagcaggtgggggcacttctccctctaacactctccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaagggaccaacggtggaagtcaaacgaa

SEQ ID NO: 591231 - DNA, 454 bp, Homo sapiens; identical to SEQ ID NO: 536347
  misc_feature: HIJSMM301C0ED0.19.86.H09.1.454.light.4.raw

SEQ ID NO: 591232 - DNA, 486 bp, Homo sapiens
  misc_feature: HIJSMM301D2QD2.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaagaa

SEQ ID NO: 591233 - DNA, 494 bp, Homo sapiens; identical to SEQ ID NO: 534992
  misc_feature: HIJSMM301D0OW4.9.1.A01.1.454.light.4.raw

SEQ ID NO: 591234 - DNA, 479 bp, Homo sapiens; identical to SEQ ID NO: 535118
  misc_feature: HIJSMM301AY907.13.59.F04.1.454.light.4.raw

SEQ ID NO: 591235 - DNA, 475 bp, Homo sapiens
  misc_feature: HIJSMM301BOR89.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgtattttcggcggagggaccaagctgaccgt

SEQ ID NO: 591236 - DNA, 488 bp, Homo sapiens
  misc_feature: HIJSMM301EV9H3.41.59.F04.1.454.light.4.raw
tctatactatcacgaccggtgctcgatttagtacacacacttagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcaccat

SEQ ID NO: 591237 - DNA, 504 bp, Homo sapiens
  misc_feature: HIJSMM301COEVI.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggaggaccaagttgaccgtcctaggtcagcccaaggctgcccctcggtcact

SEQ ID NO: 591238 - DNA, 465 bp, Homo sapiens
  misc_feature: HIJSMM301EEP00.21.76.G10.1.454.light.4.raw
tcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgggtcaggacattagacattatttagcctggtatcagcagaaaccaggtaaagttcccaagctcctgatctatgctgcatcctctttgcaatcaggggtcccatctcggttcagtggcagtggatctgggacagatttcactctcaccatcagcagcctgcagcctgaagatgttgcaacttattactgtacaaaaatatagcagtgcccctctcactttcggcgcagggaccaaggtggacatcaaacg

SEQ ID NO: 591239 - DNA, 500 bp, Homo sapiens; identical to SEQ ID NO: 542309
  misc_feature: HIJSMM301DKFWC.12.86.H09.1.454.light.4.raw

SEQ ID NO: 591240 - DNA, 485 bp, Homo sapiens
  misc_feature: HIJSMM301CR1GZ.52.73.G07.1.454.light.4.raw
cgcagtacgacacgaccggtgctcgatttagctctacgctcaggggactgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaactgtgg

SEQ ID NO: 591241 - DNA, 490 bp, Homo sapiens
  misc_feature: HIJSMM301AMAMR.48.35.D02.1.454.light.4.raw
agtatacatacacgaccggtgctcgatttagcacacgatagttgggtttgggggggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 591242 - DNA, 505 bp, Homo sapiens
  misc_feature: HIJSMM301CV9BI.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggatgaggctgactattactgccagtcctatgacatgaggctgagttggttcgtatgtcttcggatctgggaccaaggtcaccgtcctaagtcagcccaaggccctaa

SEQ ID NO: 591243 - DNA, 520 bp, Homo sapiens; identical to SEQ ID NO: 537173
  misc_feature: HIJSMM301DWQ9M.27.23.C01.1.454.light.4.raw

SEQ ID NO: 591244 - DNA, 500 bp, Homo sapiens
  misc_feature: HIJSMM301D4CY6.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggaggatcaaacgaactagtggctg

SEQ ID NO: 591245 - DNA, 512 bp, Homo sapiens
  misc_feature: HIJSMM301DE021.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaatatgtttattggtaccaacagaagtcaggccaggcccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccacctcct

SEQ ID NO: 591246 - DNA, 503 bp, Homo sapiens
  misc_feature: HIJSMM301B33TZ.49.30.C08.1.454.light.4.raw
agtcgagagacacgaccggtgctcgatttagtctgacgtcaaagggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagacctttcggccaagggaccaaggtggaaatcaaacgaactgtggctgcaccatctgtcttcatcttcccgccat

SEQ ID NO: 591247 - DNA, 489 bp, Homo sapiens; identical to SEQ ID NO: 541702
  misc_feature: HIJSMM301AX3GA.10.72.G06.1.454.light.4.raw

SEQ ID NO: 591248 - DNA, 501 bp, Homo sapiens; identical to SEQ ID NO: 535746
  misc_feature: HIJSMM301DK7N8.18.11.A11.1.454.light.4.raw

SEQ ID NO: 591249 - DNA, 478 bp, Homo sapiens
  misc_feature: HIJSMM301BPCXU.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgacccattacctggactccagcctgaggacgaggctgactattactgctcagcatgggacagcagcctccgtggtgtggtgatcggcggagggaccaggctgaccgtcct

SEQ ID NO: 591250 - DNA, 491 bp, Homo sapiens
  misc_feature: HIJSMM301DOUP1.16.68.G02.1.454.light.4.raw
  modified_base (488)..(488): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttnatt

SEQ ID NO: 591251 - DNA, 447 bp, Homo sapiens
  misc_feature: HIJSMM301DWVTD.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccgccctcctccatactcta

SEQ ID NO: 591252 - DNA, 503 bp, Homo sapiens
  misc_feature: HIJSMM301C3DU2.5.86.H09.1.454.light.4.raw
  modified_base (324)..(324): a, c, t, g, unknown or other
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctnaggggtccctgatcgcttctctggctccaagtctggcaacacggcctcctgaccgtctctgggctccagactgaggatgaggctgactattactgcagctcatttgcaggcagccgtatactcttcggcggagggaccaaggctgaccgtcctaggtcagcccgaaggctcgccccctc

SEQ ID NO: 591253 - DNA, 523 bp, Homo sapiens
  misc_feature: HIJSMM301B55H3.8.39.D06.1.454.light.4.raw
  modified_base (502)..(502): a, c, t, g, unknown or other
ctcgcgtgtccacgaccggtgctcgatttagtgacatctcgcagttctttggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccaaggaccgaaggtaggcgaatacaaccgaaacctgtggcgtgcacccatctntcttccatcttcccgtccact

SEQ ID NO: 591254 - DNA, 504 bp, Homo sapiens; identical to SEQ ID NO: 540538
  misc_feature: HIJSMM301ARYGK.7.71.G05.1.454.light.4.raw

SEQ ID NO: 591255 - DNA, 516 bp, Homo sapiens; identical to SEQ ID NO: 535549
  misc_feature: HIJSMM301DHGFQ.14.70.G04.1.454.light.4.raw

SEQ ID NO: 591256 - DNA, 511 bp, Homo sapiens; identical to SEQ ID NO: 535406
  misc_feature: HIJSMM301A47CA.43.59.F04.1.454.light.4.raw

SEQ ID NO: 591257 - DNA, 492 bp, Homo sapiens
  misc_feature: HIJSMM301CEBNM.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggcgaatccaacagggccactggcatcccagacaggttcagtggcagtgggtctgggacagacttcactctcaccatcagcagactggagcctgaggattttgcagtgtattactgtcagcagtatcataggtcaaacaccttcggcccaagggacacgactggagattaaaggaactgtggctgcaccatctgtcttcatcttcc

SEQ ID NO: 591258 - DNA, 476 bp, Homo sapiens
  misc_feature: HIJSMM301D2HO2.14.5.A05.1.454.light.4.raw
cgtctagtaccacgaccggtgctcgatttagatagatagacagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccattctgtcttcatcttccgccat

SEQ ID NO: 591259 - DNA, 484 bp, Homo sapiens; identical to SEQ ID NO: 535211
  misc_feature: HIJSMM301C8SWC.47.46.E02.1.454.light.4.raw

SEQ ID NO: 591260 - DNA, 514 bp, Homo sapiens; identical to SEQ ID NO: 557408
  misc_feature: HIJSMM301EDIXQ.8.43.D10.1.454.light.4.raw

SEQ ID NO: 591261 - DNA, 441 bp, Homo sapiens
  misc_feature: HIJSMM301D3EM5.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 591262 - DNA, 485 bp, Homo sapiens; identical to SEQ ID NO: 542735
  misc_feature: HIJSMM301C68OW.26.45.E01.1.454.light.4.raw

SEQ ID NO: 591263 - DNA, 491 bp, Homo sapiens
  misc_feature: HIJSMM301AU20A.40.38.D05.1.454.light.4.raw
tctagcgactcacgaccggtgctcgatttagtatctgatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagccc

SEQ ID NO: 591264 - DNA, 488 bp, Homo sapiens
  misc_feature: HIJSMM301BZ41W.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaactcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccat

SEQ ID NO: 591265 - DNA, 485 bp, Homo sapiens
  misc_feature: HIJSMM301DWJEV.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctcgccccctcggtctac

SEQ ID NO: 591266 - DNA, 497 bp, Homo sapiens
  misc_feature: HIJSMM301BZXPQ.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggagtgtctaagcgaactcgtggcgtgcgaccactctcg

SEQ ID NO: 591267 - DNA, 502 bp, Homo sapiens
  misc_feature: HIJSMM301E1RVX.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgcggtttattactgtcagcagtataataactggcctccacggtactacttttggccgaggggaccaagcgtggagatacaaacgaactgtggctgcaccatctgtt

SEQ ID NO: 591268 - DNA, 471 bp, Homo sapiens
  misc_feature: HIJSMM301CNMVQ.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccat

SEQ ID NO: 591269 - DNA, 519 bp, Homo sapiens; identical to SEQ ID NO: 575476
  misc_feature: HIJSMM301EMKLU.27.23.C01.1.454.light.4.raw

SEQ ID NO: 591270 - DNA, 505 bp, Homo sapiens; identical to SEQ ID NO: 586297
  misc_feature: HIJSMM301BPEHN.8.28.C06.1.454.light.4.raw

SEQ ID NO: 591271 - DNA, 473 bp, Homo sapiens
  misc_feature: HIJSMM301AXWZS.51.41.D08.1.454.light.4.raw
cgatcgtatacacgaccggtgctcgatttagtcacgcgagaaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaa

SEQ ID NO: 591272 - DNA, 444 bp, Homo sapiens; identical to SEQ ID NO: 534993
  misc_feature: HIJSMM301C2OV7.5.9.A09.1.454.light.4.raw

SEQ ID NO: 591273 - DNA, 506 bp, Homo sapiens; identical to SEQ ID NO: 534969
  misc_feature: HIJSMM301CCAIT.18.37.D04.1.454.light.4.raw

SEQ ID NO: 591274 - DNA, 447 bp, Homo sapiens
  misc_feature: HIJSMM301EWFR1.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaaggtcacgtcctaagtcagcccaaggccaacccctctgtcactctgttcccaccctcctccatactcgta

SEQ ID NO: 591275 - DNA, 504 bp, Homo sapiens; identical to SEQ ID NO: 549053
  misc_feature: HIJSMM301EMCZC.4.71.G05.1.454.light.4.raw

SEQ ID NO: 591276 - DNA, 510 bp, Homo sapiens
  misc_feature: HIJSMM301ADRQH.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactcgt

SEQ ID NO: 591277 - DNA, 486 bp, Homo sapiens
  misc_feature: HIJSMM301D3NJ2.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggcccaaccc

SEQ ID NO: 591278 - DNA, 484 bp, Homo sapiens
  misc_feature: HIJSMM301BP8FS.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggcctggaccatagtggatatgaaacgaactgtggctgcacc

SEQ ID NO: 591279 - DNA, 486 bp, Homo sapiens; identical to SEQ ID NO: 537310
  misc_feature: HIJSMM301EGVZ2.15.28.C06.1.454.light.4.raw

SEQ ID NO: 591280 - DNA, 509 bp, Homo sapiens
  misc_feature: HIJSMM301C5YVD.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccgaagctgaccgtcttaagtcagcccaagctgccccctcggtcactctgttccgt

SEQ ID NO: 591281 - DNA, 521 bp, Homo sapiens; identical to SEQ ID NO: 538715
  misc_feature: HIJSMM301BRZ7V.27.23.C01.1.454.light.4.raw

SEQ ID NO: 591282 - DNA, 503 bp, Homo sapiens
  misc_feature: HIJSMM301AKRHL.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggtcgggggaccgggaaggtaggaggagtacaaacgaaactaagtggtcgtgcgaccact

SEQ ID NO: 591283 - DNA, 519 bp, Homo sapiens; identical to SEQ ID NO: 541985
  misc_feature: HIJSMM301BMHLH.41.25.C03.1.454.light.4.raw

SEQ ID NO: 591284 - DNA, 503 bp, Homo sapiens; identical to SEQ ID NO: 536834
  misc_feature: HIJSMM301CNOHG.2.35.D02.1.454.light.4.raw

SEQ ID NO: 591285 - DNA, 494 bp, Homo sapiens; identical to SEQ ID NO: 534994
  misc_feature: HIJSMM301D4ASI.27.78.H01.1.454.light.4.raw

SEQ ID NO: 591286 - DNA, 472 bp, Homo sapiens; identical to SEQ ID NO: 536302
  misc_feature: HIJSMM301EDN5Q.18.76.G10.1.454.light.4.raw

SEQ ID NO: 591287 - DNA, 497 bp, Homo sapiens; identical to SEQ ID NO: 535286
  misc_feature: HIJSMM301ENJVZ.18.59.F04.1.454.light.4.raw

SEQ ID NO: 591288 - DNA, 496 bp, Homo sapiens
  misc_feature: HIJSMM301AMSI4.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaaggaccgaacggtggaagtacaaacgaactagtggcgtgcaccatctgtctt

SEQ ID NO: 591289 - DNA, 503 bp, Homo sapiens
  misc_feature: HIJSMM301DLG47.18.78.H01.1.454.light.4.raw
  modified_base (437)..(437): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggcctcaggggtttctaatcgcttctctggctccaagtctggcaacacggcctcctgaccatctctgggctccaggctgaggacgaggctgattattactgcagctcatatacaagcagcancactcaagtcttcggaactgggaccaaggtcaccgtctaggtcagcccaaggccaacccactgtca

SEQ ID NO: 591290 - DNA, 509 bp, Homo sapiens
  misc_feature: HIJSMM301C7QIL.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctcctaaccatctctgggctccagtttgaggacgagtctacttattactgcagttccttaaattaggcgccactctcgtggttttcggcggaggcaccgaagtgaccgtcctcggtcagcccaaggctgccccctggtcact

SEQ ID NO: 591291 - DNA, 530 bp, Homo sapiens
  misc_feature: HIJSMM301D33PB.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgacggaccgaacggtaggaaggtacgaaacgaaaccgtaagtggtcgtgtcaccactactcgtcttctatcttcccgtcccactctcgt

SEQ ID NO: 591292 - DNA, 502 bp, Homo sapiens
  misc_feature: HIJSMM301CJ65Y.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcaggccaaggctgccccctcggtca

SEQ ID NO: 591293 - DNA, 497 bp, Homo sapiens
  misc_feature: HIJSMM301C22T7.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggacttatgtcttcggaactgcgaccaaaggtcaccgtcctgggtcagcccaaggccaaccccactgtcactcttcg

SEQ ID NO: 591294 - DNA, 444 bp, Homo sapiens
  misc_feature: HIJSMM301B3W7K.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccttggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 591295 - DNA, 495 bp, Homo sapiens; identical to SEQ ID NO: 550081
  misc_feature: HIJSMM301AR5TI.43.39.D06.1.454.light.4.raw

SEQ ID NO: 591296 - DNA, 508 bp, Homo sapiens
  misc_feature: HIJSMM301EOZ94.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggtccaagggaccgaaaggtaggagtaatcaagacgaactagtggcgtgccg

SEQ ID NO: 591297 - DNA, 495 bp, Homo sapiens; identical to SEQ ID NO: 536055
  misc_feature: HIJSMM301AMEN7.47.38.D05.1.454.light.4.raw

SEQ ID NO: 591298 - DNA, 502 bp, Homo sapiens; identical to SEQ ID NO: 553118
  misc_feature: HIJSMM301DMBGH.10.9.A09.1.454.light.4.raw

SEQ ID NO: 591299 - DNA, 475 bp, Homo sapiens; identical to SEQ ID NO: 537570
  misc_feature: HIJSMM301DAAYB.13.4.A04.1.454.light.4.raw

SEQ ID NO: 591300 - DNA, 488 bp, Homo sapiens
  misc_feature: HIJSMM301CSYYH.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatgttacccgctcagtttcggcggagggaccaaggtggagatcaaacgaactgtggctgcaccatctgtt

SEQ ID NO: 591301 - DNA, 519 bp, Homo sapiens
  misc_feature: HIJSMM301A358V.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccaccctcctcat

SEQ ID NO: 591302 - DNA, 483 bp, Homo sapiens
  misc_feature: HIJSMM301B9LH5.49.45.E01.1.454.light.4.raw
agtcgagagacacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatcttccgccat

SEQ ID NO: 591303 - DNA, 506 bp, Homo sapiens
  misc_feature: HIJSMM301C1ABQ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactcgtggctgcaccatctgtctt

SEQ ID NO: 591304 - DNA, 499 bp, Homo sapiens
  misc_feature: HIJSMM301AIRE3.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtccgtgggtcacgacccaaggcccaaccccactgtcta

SEQ ID NO: 591305 - DNA, 507 bp, Homo sapiens
  misc_feature: HIJSMM301DVAQY.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtctaagtcagcccaaggctgccccctcggtcactctcgttcccgccctcc

SEQ ID NO: 591306 - DNA, 516 bp, Homo sapiens
  misc_feature: HIJSMM301BS2T2.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactgcaaccagcagtgacgttaatgataataactatttctcctggtaccagcaacacccaggcaaagcccccaaactcctcatttatggtgtcgggaatcggccctcaggggtttctaatcgcttctctggctccaagtctggcaaacggcctccctgaccatctctggactccagcctgaggacgaggccgattactactgcattgcacagacaaggagtcccacttgggtgttcggcggagggaccaaactgaccgtcctaggtcagcccaaggctgccccctcggtcactctgttcccta

SEQ ID NO: 591307 - DNA, 484 bp, Homo sapiens
  misc_feature: HIJSMM301EQ4QK.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgt

SEQ ID NO: 591308 - DNA, 499 bp, Homo sapiens; identical to SEQ ID NO: 536187
  misc_feature: HIJSMM301BSC2U.11.67.G01.1.454.light.4.raw

SEQ ID NO: 591309 - DNA, 514 bp, Homo sapiens
  misc_feature: HIJSMM301AWDX0.9.12.B01.1.454.light.4.raw
tgatacgtctcacgaccggtgctcgatttagtagtgtagattccgcgggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggccgaagatgtggcagtttattactgtcaacagttttctcgggcgttcggccagggaaccgaaggtaggaaagtacaaacgaaactagtggcgtgcgaccatctcgtcttcattccttcccgt

SEQ ID NO: 591310 - DNA, 499 bp, Homo sapiens; identical to SEQ ID NO: 575204
  misc_feature: HIJSMM301DHIXN.5.24.C02.1.454.light.4.raw

SEQ ID NO: 591311 - DNA, 420 bp, Homo sapiens; identical to SEQ ID NO: 540533
  misc_feature: HIJSMM301EZHO8.9.34.D01.1.454.light.4.raw

SEQ ID NO: 591312 - DNA, 486 bp, Homo sapiens
  misc_feature: HIJSMM301CWH4E.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaacgaactgtggctgcaccta

SEQ ID NO: 591313 - DNA, 504 bp, Homo sapiens
  misc_feature: HIJSMM301ADCGU.40.55.E11.1.454.light.4.raw
tctagcgactcacgaccggtgctcgatttagcactcgcacgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgtttcggcggagggaccaagctgaccgtcctaggtcagcccaaggctgccccctc

SEQ ID NO: 591314 - DNA, 449 bp, Homo sapiens
  misc_feature: HIJSMM301B1UI6.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctcctgtcactctgttcccaccctcctccactactcgta

SEQ ID NO: 591315 - DNA, 498 bp, Homo sapiens
  misc_feature: HIJSMM301EDC46.48.80.H03.1.454.light.4.raw
agtatacatacacgaccggtgctcgatttagctgtgcgtcgaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttggccaagggacacgactggagattaaacgactgtggctgcaccatctgtcttcatcttccccg

SEQ ID NO: 591316 - DNA, 520 bp, Homo sapiens
  misc_feature: HIJSMM301EJVYG.49.22.B11.1.454.light.4.raw
agtcgagagacacgaccggtgctcgatttagacgacagctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctcgccccctcggtcactctcgttcccaccctcctctctctcg

SEQ ID NO: 591317 - DNA, 486 bp, Homo sapiens; identical to SEQ ID NO: 535385
  misc_feature: HIJSMM301CH843.19.71.G05.1.454.light.4.raw

SEQ ID NO: 591318 - DNA, 501 bp, Homo sapiens
  misc_feature: HIJSMM301EN4O6.43.69.G03.1.454.light.4.raw
tgtgagtagtcacgaccggtgctcgatttagtcgctgcgtaaaggagaaaggggggtgggtccaggaggcagaactctgggtgtctcaccatggcctggatccctctacttctccccctcctcactctctgcacaggctctgaggccgcctatgaggtgacacagccacactcggtgtcagtgtcccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgctattattgtcaagcagtagacagcagtggtccttatcgggtgttcggcgggggaccgaagctgaccgtcctaggtcagcccaaggctgccccctcggtcact

SEQ ID NO: 591319 - DNA, 491 bp, Homo sapiens; identical to SEQ ID NO: 536211
  misc_feature: HIJSMM301DVO08.16.53.E09.1.454.light.4.raw

SEQ ID NO: 591320 - DNA, 495 bp, Homo sapiens; identical to SEQ ID NO: 588904
  misc_feature: HIJSMM301A66AU.11.81.H04.1.454.light.4.raw

SEQ ID NO: 591321 - DNA, 384 bp, Homo sapiens; identical to SEQ ID NO: 572833
  misc_feature: HIJSMM301BU37R.48.37.D04.1.454.light.4.raw

SEQ ID NO: 591322 - DNA, 447 bp, Homo sapiens; identical to SEQ ID NO: 535201
  misc_feature: HIJSMM301CG4H8.18.9.A09.1.454.light.4.raw

SEQ ID NO: 591323 - DNA, 516 bp, Homo sapiens
  misc_feature: HIJSMM301DGLPG.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggaggggaccaagctgaccgtcctcggtcagcccaaggctgccccctcggtcactctgttcccgccctcct

SEQ ID NO: 591324 - DNA, 516 bp, Homo sapiens
  misc_feature: HIJSMM301A6VB7.48.17.B06.1.454.light.4.raw
agtatacatacacgaccggtgctcgatttagtcgatagtgaagggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccgccct

SEQ ID NO: 591325 - DNA, 495 bp, Homo sapiens; identical to SEQ ID NO: 588904
  misc_feature: HIJSMM301EXZP8.11.81.H04.1.454.light.4.raw

SEQ ID NO: 591326 - DNA, 468 bp, Homo sapiens
  misc_feature: HIJSMM301BOVXW.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgcttctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctccgctcactttcggcggagggaccaaggtggagatcaaacgaa

SEQ ID NO: 591327 - DNA, 454 bp, Homo sapiens; identical to SEQ ID NO: 534964
  misc_feature: HIJSMM301C8GOG.19.86.H09.1.454.light.4.raw

SEQ ID NO: 591328 - DNA, 518 bp, Homo sapiens
  misc_feature: HIJSMM301DJ787.49.35.D02.1.454.light.4.raw
agtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgcccccgtcgcactcgtcgtcccgt

SEQ ID NO: 591329 - DNA, 496 bp, Homo sapiens
  misc_feature: HIJSMM301BAOWM.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatactatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 591330 - DNA, 506 bp, Homo sapiens
  misc_feature: HIJSMM301AYVIZ.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcgacgtccacgctgccctcgtacg

SEQ ID NO: 591331 - DNA, 489 bp, Homo sapiens; identical to SEQ ID NO: 535139
  misc_feature: HIJSMM301CPXL7.14.55.E11.1.454.light.4.raw

SEQ ID NO: 591332 - DNA, 495 bp, Homo sapiens
  misc_feature: HIJSMM301CPSM3.51.81.H04.1.454.light.4.raw
cgatcgtatacacgaccggtgctcgatttagtagtgtagattcgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccaattggtacttatgtcttcggaactgcgacaaggtcaccgtctgggtcagcccaaggcccaacccactcgtcactctgtt

SEQ ID NO: 591333 - DNA, 506 bp, Homo sapiens
  misc_feature: HIJSMM301CYDRM.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcatcttcccgccta

SEQ ID NO: 591334 - DNA, 513 bp, Homo sapiens
  misc_feature: HIJSMM301DSJB5.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccatgtcactcctgttccccacctcctcga

SEQ ID NO: 591335 - DNA, 486 bp, Homo sapiens; identical to SEQ ID NO: 537310
  misc_feature: HIJSMM301DO0VD.15.28.C06.1.454.light.4.raw

SEQ ID NO: 591336 - DNA, 486 bp, Homo sapiens; identical to SEQ ID NO: 548936
  misc_feature: HIJSMM301A4OC3.5.55.E11.1.454.light.4.raw

SEQ ID NO: 591337 - DNA, 514 bp, Homo sapiens; identical to SEQ ID NO: 538541
  misc_feature: HIJSMM301BNS6G.47.23.C01.1.454.light.4.raw

SEQ ID NO: 591338 - DNA, 502 bp, Homo sapiens
  misc_feature: HIJSMM301DBFVN.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcgggttggtgttcggcggagggaccaaacgtgaccgtcctaggtcagcccc

SEQ ID NO: 591339 - DNA, 500 bp, Homo sapiens
  misc_feature: HIJSMM301B16QR.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctggggacagatttcactctcaccatcagcagccttcaggctgaagatgtggcagtttattactgtcagcaatattatatctctcctcctcggacgttcggccaaggaccgagggtggaaatcaaacgaactgtggctgcaccatctgtcttcatcttcccgccat

SEQ ID NO: 591340 - DNA, 506 bp, Homo sapiens
  misc_feature: HIJSMM301C8TBJ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagtcggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 591341 - DNA, 523 bp, Homo sapiens
  misc_feature: HIJSMM301AKWKQ.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttgggggtttattacttgcatgcaaggtactacaaaccccgactacaccttcggtccggacgggacgacgccctcggagaagttaaacgtaaactagtggtcgtgcacccaatcttcg

SEQ ID NO: 591342 - DNA, 518 bp, Homo sapiens
  misc_feature: HIJSMM301BN0QT.27.23.C01.1.454.light.4.raw
  modified_base (508)..(508): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaggctgccccctggtcactcngttcccgcct

SEQ ID NO: 591343 - DNA, 514 bp, Homo sapiens
  misc_feature: HIJSMM301D431F.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacacaggaagtagcacatgggtgtgcggcggagggacgaaggtgaccgtcctgggtcgagcccaacggctcgccccctcggtcacttcc

SEQ ID NO: 591344 - DNA, 524 bp, Homo sapiens
  misc_feature: HIJSMM301EM8Y8.13.53.E09.1.454.light.4.raw
  modified_base (512)..(512): a, c, t, g, unknown or other
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagtttaccttcctccccccgggacgttcggtccgaacggaaccgaaggtacggaaagtacaagacgaacgtacgtggcgtcgtcgaccactctnttcgttctactt

SEQ ID NO: 591345 - DNA, 493 bp, Homo sapiens
  misc_feature: HIJSMM301EH6V1.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggc

SEQ ID NO: 591346 - DNA, 508 bp, Homo sapiens
  misc_feature: HIJSMM301EC7H9.4.21.B10.1.454.light.4.raw
  modified_base (241)..(241): a, c, t, g, unknown or other
agcactgtagcacgaccggtgctcgatttagtgtcgtcgcaagagagagaggaggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatntgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataaattctgggtgttcggcggaggggaccaaactgaccgtcctaggtcagcccaaggctgccccctcggtcactctcg

SEQ ID NO: 591347 - DNA, 483 bp, Homo sapiens; identical to SEQ ID NO: 535413
  misc_feature: HIJSMM301CZAEZ.26.78.H01.1.454.light.4.raw

SEQ ID NO: 591348 - DNA, 509 bp, Homo sapiens; identical to SEQ ID NO: 541417
  misc_feature: HIJSMM301DZ8X9.16.46.E02.1.454.light.4.raw

SEQ ID NO: 591349 - DNA, 444 bp, Homo sapiens; identical to SEQ ID NO: 535192
  misc_feature: HIJSMM301ETHRY.5.9.A09.1.454.light.4.raw

SEQ ID NO: 591350 - DNA, 378 bp, Homo sapiens; identical to SEQ ID NO: 547290
  misc_feature: HIJSMM301CXYU4.40.9.A09.1.454.light.4.raw

SEQ ID NO: 591351 - DNA, 494 bp, Homo sapiens; identical to SEQ ID NO: 534992
  misc_feature: HIJSMM301CCSTG.9.1.A01.1.454.light.4.raw

SEQ ID NO: 591352 - DNA, 499 bp, Homo sapiens
  misc_feature: HIJSMM301EFDL8.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgcccctcggtcactc

SEQ ID NO: 591353 - DNA, 504 bp, Homo sapiens; identical to SEQ ID NO: 557936
  misc_feature: HIJSMM301A35I2.19.78.H01.1.454.light.4.raw

SEQ ID NO: 591354 - DNA, 489 bp, Homo sapiens; identical to SEQ ID NO: 535139
  misc_feature: HIJSMM301CRLAP.14.55.E11.1.454.light.4.raw

SEQ ID NO: 591355 - DNA, 510 bp, Homo sapiens
  misc_feature: HIJSMM301D2085.43.3.A03.1.454.light.4.raw
tgtgagtagtcacgaccggtgctcgatttagagagcgtcacaggggctggtggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacaggggtgttcggcggagggaccagggttgacccgttccttggtcagcccaaggctcgccccctcggtcactc

SEQ ID NO: 591356 - DNA, 513 bp, Homo sapiens
  misc_feature: HIJSMM301CLDER.9.43.D10.1.454.light.4.raw
tgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccgccctcctctacg

SEQ ID NO: 591357 - DNA, 483 bp, Homo sapiens
  misc_feature: HIJSMM301AMJFV.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgtattttgcgtacttattattgccaacagtataagagttattcaactttcggccctggaccaatgtgatatacaaacgaactgtggctgcaccatctgtctt

SEQ ID NO: 591358 - DNA, 506 bp, Homo sapiens; identical to SEQ ID NO: 539056
  misc_feature: HIJSMM301CKOFY.52.69.G03.1.454.light.4.raw

SEQ ID NO: 591359 - DNA, 507 bp, Homo sapiens
  misc_feature: HIJSMM301B0BR1.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccgaagctgaccgtcctaggtcagcccaaggctgtccccccg

SEQ ID NO: 591360 - DNA, 507 bp, Homo sapiens
  misc_feature: HIJSMM301BG1LU.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactcttccg

SEQ ID NO: 591361 - DNA, 487 bp, Homo sapiens
  misc_feature: HIJSMM301DKDIZ.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtcctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 591362 - DNA, 485 bp, Homo sapiens
  misc_feature: HIJSMM301EMZYP.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcgggcggagggaccaactgaccgtcctaggtcagcccaaggctgccccccg

SEQ ID NO: 591363 - DNA, 477 bp, Homo sapiens; identical to SEQ ID NO: 559245
  misc_feature: HIJSMM301DKH7M.41.24.C02.1.454.light.4.raw

SEQ ID NO: 591364 - DNA, 490 bp, Homo sapiens
  misc_feature: HIJSMM301BWU4U.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatcccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggcctaggggaccaaggttggagatcaaacgaact

SEQ ID NO: 591365 - DNA, 514 bp, Homo sapiens
  misc_feature: HIJSMM301DJ4UM.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtccactctgttcccgccctcctcga

SEQ ID NO: 591366 - DNA, 484 bp, Homo sapiens; identical to SEQ ID NO: 535240
  misc_feature: HIJSMM301AXE4L.47.60.F05.1.454.light.4.raw

SEQ ID NO: 591367 - DNA, 489 bp, Homo sapiens
  misc_feature: HIJSMM301AND25.49.33.C11.1.454.light.4.raw
agtcgagagacacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgtt

SEQ ID NO: 591368 - DNA, 473 bp, Homo sapiens; identical to SEQ ID NO: 569938
  misc_feature: HIJSMM301B6SW7.18.76.G10.1.454.light.4.raw

SEQ ID NO: 591369 - DNA, 460 bp, Homo sapiens; identical to SEQ ID NO: 539553
  misc_feature: HIJSMM301A7IWL.11.86.H09.1.454.light.4.raw

SEQ ID NO: 591370 - DNA, 485 bp, Homo sapiens; identical to SEQ ID NO: 536576
  misc_feature: HIJSMM301D4DKE.46.35.D02.1.454.light.4.raw

SEQ ID NO: 591371 - DNA, 509 bp, Homo sapiens; identical to SEQ ID NO: 562833
  misc_feature: HIJSMM301DZILM.43.67.G01.1.454.light.4.raw

SEQ ID NO: 591372 - DNA, 444 bp, Homo sapiens; identical to SEQ ID NO: 537971
  misc_feature: HIJSMM301ARTAN.2.76.G10.1.454.light.4.raw

SEQ ID NO: 591373 - DNA, 509 bp, Homo sapiens
  misc_feature: HIJSMM301D6U5T.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaaggacgaacggtaggaaagtacaaacgaaactagtggcgtgcaccaatctgtcttctatcttccccg

SEQ ID NO: 591374 - DNA, 482 bp, Homo sapiens
  misc_feature: HIJSMM301C098F.48.19.B08.1.454.light.4.raw
  modified_base (443)..(443): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctcctgaccatctctgggctccaggctgaggatgaggctgattattactgctgctcatatgcaggcagctacacttgggtnttcggcggagggaccaaggctgaccgtcctaggtcacgg

SEQ ID NO: 591375 - DNA, 497 bp, Homo sapiens
  misc_feature: HIJSMM301BUOBS.48.83.H06.1.454.light.4.raw
  modified_base (465)..(465): a, c, t, g, unknown or other
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcngccaaggctcgcccctcggtcactctgttccg

SEQ ID NO: 591376 - DNA, 502 bp, Homo sapiens
  misc_feature: HIJSMM301AK4IX.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgcccccc

SEQ ID NO: 591377 - DNA, 491 bp, Homo sapiens
  misc_feature: HIJSMM301BTSDX.51.82.H05.1.454.light.4.raw
cgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgataccagaaatcggccctcgggggtccctgaccgattctctggctccaagtctgacacttcagcctccctggccatcactgggctccagactgaggatgaggctgactattactgccagtcctatgacagcaggctgactgctgtggtttcggcggcgggaccaagctgaccgtcctaggtcaccg

SEQ ID NO: 591378 - DNA, 495 bp, Homo sapiens; identical to SEQ ID NO: 554198
  misc_feature: HIJSMM301ARJZ7.41.53.E09.1.454.light.4.raw

SEQ ID NO: 591379 - DNA, 497 bp, Homo sapiens; identical to SEQ ID NO: 554406
  misc_feature: HIJSMM301DAIBJ.3.33.C11.1.454.light.4.raw

SEQ ID NO: 591380 - DNA, 486 bp, Homo sapiens; identical to SEQ ID NO: 535385
  misc_feature: HIJSMM301DUN9X.19.71.G05.1.454.light.4.raw

SEQ ID NO: 591381 - DNA, 485 bp, Homo sapiens
  misc_feature: HIJSMM301AXK6S.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccagggaccaaggtggatatcagacgaa

SEQ ID NO: 591382 - DNA, 486 bp, Homo sapiens; identical to SEQ ID NO: 535385
  misc_feature: HIJSMM301AMOKR.19.71.G05.1.454.light.4.raw

SEQ ID NO: 591383 - DNA, 478 bp, Homo sapiens
  misc_feature: HIJSMM301ESC1A.52.54.E10.1.454.light.4.raw
cgcagtacgacacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagggcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggaggatcagacgtaacg

SEQ ID NO: 591384 - DNA, 446 bp, Homo sapiens
  misc_feature: HIJSMM301DXR9Y.18.9.A09.1.454.light.4.raw
  modified_base (429)..(429): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccncctcctccatactcgta

SEQ ID NO: 591385 - DNA, 505 bp, Homo sapiens
  misc_feature: HIJSMM301CH7R4.18.78.H01.1.454.light.4.raw
  modified_base (440)..(440): a, c, t, g, unknown or other
  modified_base (502)..(502): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagnactcaagtcttcggaactgggaccaaggtcaccgtcctaggtcagcccaaggcaacccactntca

SEQ ID NO: 591386 - DNA, 495 bp, Homo sapiens
  misc_feature: HIJSMM301BWMD3.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctggtcagcccaaggccaacccactcgtcactc

SEQ ID NO: 591387 - DNA, 502 bp, Homo sapiens; identical to SEQ ID NO: 540196
  misc_feature: HIJSMM301CM3R6.40.45.E01.1.454.light.4.raw

SEQ ID NO: 591388 - DNA, 447 bp, Homo sapiens
  misc_feature: HIJSMM301BP3N4.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactggactccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 591389 - DNA, 484 bp, Homo sapiens
  misc_feature: HIJSMM301D7PQF.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataataggttatgaatccacttttggtccaagggaccaagctggagatcaaacgaactgtggc

SEQ ID NO: 591390 - DNA, 494 bp, Homo sapiens; identical to SEQ ID NO: 534992
  misc_feature: HIJSMM301DB0RS.9.1.A01.1.454.light.4.raw

SEQ ID NO: 591391 - DNA, 508 bp, Homo sapiens; identical to SEQ ID NO: 540739
  misc_feature: HIJSMM301CNPCG.14.7.A07.1.454.light.4.raw

SEQ ID NO: 591392 - DNA, 498 bp, Homo sapiens
  misc_feature: HIJSMM301BVG4M.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccaccc

SEQ ID NO: 591393 - DNA, 505 bp, Homo sapiens
  misc_feature: HIJSMM301EDC9S.10.21.B10.1.454.light.4.raw
catagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttccggcggagggaccaaaatagaggtcaaacgaactgtggctgcaccatctgtcttcta

SEQ ID NO: 591394 - DNA, 515 bp, Homo sapiens
  misc_feature: HIJSMM301AZOHW.15.86.H09.1.454.light.4.raw
  modified_base (503)..(503): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctccncgctacgttaga

SEQ ID NO: 591395 - DNA, 479 bp, Homo sapiens; identical to SEQ ID NO: 538892
  misc_feature: HIJSMM301BL0EP.22.59.F04.1.454.light.4.raw

SEQ ID NO: 591396 - DNA, 493 bp, Homo sapiens
  misc_feature: HIJSMM301CU76Z.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggcttggttccggcggcggggacctaaggttcg

SEQ ID NO: 591397 - DNA, 444 bp, Homo sapiens; identical to SEQ ID NO: 534993
  misc_feature: HIJSMM301C1DZ4.5.9.A09.1.454.light.4.raw

SEQ ID NO: 591398 - DNA, 518 bp, Homo sapiens; identical to SEQ ID NO: 580721
  misc_feature: HIJSMM301AWOV5.43.59.F04.1.454.light.4.raw

SEQ ID NO: 591399 - DNA, 526 bp, Homo sapiens
  misc_feature: HIJSMM301EHHC9.11.58.F03.1.454.light.4.raw
cgagagataccacgaccggtgctcgatttagtctgatcgagaagggaaaggggggaagcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactaccccagttggtaccgacagaccccaggccagcctccacgcacgctcatttataacacaaagactcgctcttctggggtccctaatcgcttctctggctccatccttgggaacaaagctgccctcaccatcacgggggcccaggcggacgatgaatctatttattattgtgtactttttgtgggtcgtggcatttctgctgtgttcggcggaggcacccaggtgaccgtcctcggtcagcccaaggctgccccatcggtcactctgttcccaccct

SEQ ID NO: 591400 - DNA, 501 bp, Homo sapiens; identical to SEQ ID NO: 550407
  misc_feature: HIJSMM301AQDHF.4.39.D06.1.454.light.4.raw

SEQ ID NO: 591401 - DNA, 501 bp, Homo sapiens
  misc_feature: HIJSMM301DFSJV.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagcctgaccgtcctaggtcagcccaagg

SEQ ID NO: 591402 - DNA, 483 bp, Homo sapiens
  misc_feature: HIJSMM301A9K9M.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtcctaggtacg

SEQ ID NO: 591403 - DNA, 492 bp, Homo sapiens
  misc_feature: HIJSMM301EM0KQ.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctggaggatgcggcggttttattattgtcaacaattattttagtgctccgtacacttttggccaggggaccaaggttggagatcaaacgaa

SEQ ID NO: 591404 - DNA, 484 bp, Homo sapiens
  misc_feature: HIJSMM301DGTY9.51.11.A11.1.454.light.4.raw
cgatcgtatacacgaccggtgctcgatttagctacgactgcagggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggcggagggaccaaggtggagatcaaacgaactgtggctgcaccaatctgtcttcta

SEQ ID NO: 591405 - DNA, 519 bp, Homo sapiens
  misc_feature: HIJSMM301AGPNA.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcacttc

SEQ ID NO: 591406 - DNA, 495 bp, Homo sapiens; identical to SEQ ID NO: 538434
  misc_feature: HIJSMM301C3ZSQ.51.81.H04.1.454.light.4.raw

SEQ ID NO: 591407 - DNA, 503 bp, Homo sapiens
  misc_feature: HIJSMM301AUHAF.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggtttttcggcggagggaccaggctgacgtcctaagtcagccaaggctgcccctcggt

SEQ ID NO: 591408 - DNA, 506 bp, Homo sapiens
  misc_feature: HIJSMM301AM9K5.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagttttatttctgtcagcagtctgaagactggccgttcactttcgggcggagggaccaaggtggacctcaaacgaactgtggctgcaccatctgtcttcatcttcccgcc

SEQ ID NO: 591409 - DNA, 491 bp, Homo sapiens; identical to SEQ ID NO: 535176
  misc_feature: HIJSMM301AM59O.13.39.D06.1.454.light.4.raw

SEQ ID NO: 591410 - DNA, 485 bp, Homo sapiens; identical to SEQ ID NO: 536723
  misc_feature: HIJSMM301CO8DB.5.40.D07.1.454.light.4.raw

SEQ ID NO: 591411 - DNA, 495 bp, Homo sapiens; identical to SEQ ID NO: 538920
  misc_feature: HIJSMM301DLHOJ.47.64.F09.1.454.light.4.raw

SEQ ID NO: 591412 - DNA, 507 bp, Homo sapiens
  misc_feature: HIJSMM301CS64X.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttggatcgcagcctgactgcttacgtcttcggagctgggaccaaggtcaccgtcctaggtcagcccaaggccaacccca

SEQ ID NO: 591413 - DNA, 496 bp, Homo sapiens
  misc_feature: HIJSMM301AFHCV.48.34.D01.1.454.light.4.raw
agtatacatacacgaccggtgctcgattagatcgtctgtgttgggtttggggggggtcacatgaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttggggtgttcggcagagggaccaagctgacccgtctaggtcagcccaaggctccg

SEQ ID NO: 591414 - DNA, 501 bp, Homo sapiens
  misc_feature: HIJSMM301EW6XV.40.23.C01.1.454.light.4.raw
tctagcgactcacgaccggtgctcgatttagtacacgtgattagggattgggggggaggaactgctcagttaggacccagagggaaccatggaagccccagctcagcttctcttcctcctgctactctggctcccagataccaccggagaaattgtgttgacacagtctccagccacctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaagggtggagatcaaacgaactgtggctgcaccatctgtcttcattcc

SEQ ID NO: 591415 - DNA, 524 bp, Homo sapiens
  misc_feature: HIJSMM301CNT7Y.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactcgtcactctcgttcccaccctcccct

SEQ ID NO: 591416 - DNA, 521 bp, Homo sapiens; identical to SEQ ID NO: 539470
  misc_feature: HIJSMM301AZK7Q.27.23.C01.1.454.light.4.raw

SEQ ID NO: 591417 - DNA, 447 bp, Homo sapiens; identical to SEQ ID NO: 535020
  misc_feature: HIJSMM301BOCLS.18.9.A09.1.454.light.4.raw

SEQ ID NO: 591418 - DNA, 501 bp, Homo sapiens
  misc_feature: HIJSMM301ADFAW.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaagggaccgaaagtaggacatacaagacgaactagtggcgtgcgaccactctcgtt

SEQ ID NO: 591419 - DNA, 511 bp, Homo sapiens
  misc_feature: HIJSMM301CMH5F.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcatcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgt

SEQ ID NO: 591420 - DNA, 484 bp, Homo sapiens; identical to SEQ ID NO: 535240
  misc_feature: HIJSMM301DOREC.47.60.F05.1.454.light.4.raw

SEQ ID NO: 591421 - DNA, 507 bp, Homo sapiens
  misc_feature: HIJSMM301DYRJH.12.48.E04.1.454.light.4.raw
atacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagcccccc

SEQ ID NO: 591422 - DNA, 472 bp, Homo sapiens
  misc_feature: HIJSMM301A9Z5F.49.27.C05.1.454.light.4.raw
agtcgagagacacgaccggtgctcgatttagacgcgatcgaagggtttggggcagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgcctcacttcggtcgggggaccgaaggtaggagatcaagcgaact

SEQ ID NO: 591423 - DNA, 486 bp, Homo sapiens; identical to SEQ ID NO: 542999
  misc_feature: HIJSMM301C0D97.17.55.E11.1.454.light.4.raw

SEQ ID NO: 591424 - DNA, 504 bp, Homo sapiens; identical to SEQ ID NO: 548611
  misc_feature: HIJSMM301A9M49.48.26.C04.1.454.light.4.raw

SEQ ID NO: 591425 - DNA, 509 bp, Homo sapiens
  misc_feature: HIJSMM301DGIUT.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcgggcggagggaccaagctgaccgtcctgggtccagcccaaggctcgccccctcggtcaccg

SEQ ID NO: 591426 - DNA, 506 bp, Homo sapiens
  misc_feature: HIJSMM301DBROP.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaattgagatcaaacgaactgtggctgcaccatctgtcttcta

SEQ ID NO: 591427 - DNA, 488 bp, Homo sapiens
  misc_feature: HIJSMM301BA030.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtcttcat

SEQ ID NO: 591428 - DNA, 489 bp, Homo sapiens; identical to SEQ ID NO: 536013
  misc_feature: HIJSMM301DCPP7.26.23.C01.1.454.light.4.raw

SEQ ID NO: 591429 - DNA, 506 bp, Homo sapiens
  misc_feature: HIJSMM301CAC4S.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacactttggtccgacgggaccgaacactagaaataacaaacgaaactagtggcgtcgcaccactctcgtcttcta

SEQ ID NO: 591430 - DNA, 494 bp, Homo sapiens; identical to SEQ ID NO: 535276
  misc_feature: HIJSMM301DNPLD.16.6.A06.1.454.light.4.raw

SEQ ID NO: 591431 - DNA, 499 bp, Homo sapiens
  misc_feature: HIJSMM301CE07M.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgtcccgt

SEQ ID NO: 591432 - DNA, 496 bp, Homo sapiens
  misc_feature: HIJSMM301A20LA.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaagggacacgactggagattaaaggaactgtggctggcaccatctgtcttcatcttccccg

SEQ ID NO: 591433 - DNA, 497 bp, Homo sapiens; identical to SEQ ID NO: 538030
  misc_feature: HIJSMM301AI64Q.40.23.C01.1.454.light.4.raw

SEQ ID NO: 591434 - DNA, 497 bp, Homo sapiens
  misc_feature: HIJSMM301BS1HJ.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcacttgggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 591435 - DNA, 473 bp, Homo sapiens; identical to SEQ ID NO: 535262
  misc_feature: HIJSMM301DSGAU.8.67.G01.1.454.light.4.raw

SEQ ID NO: 591436 - DNA, 490 bp, Homo sapiens; identical to SEQ ID NO: 538714
  misc_feature: HIJSMM301AG5SL.11.12.B01.1.454.light.4.raw

SEQ ID NO: 591437 - DNA, 506 bp, Homo sapiens
  misc_feature: HIJSMM301BVZZC.27.78.H01.1.454.light.4.raw
  modified_base (486)..(486): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggtccaagggacgacgactggagattaaacgaactacgtggctgnacccccccatacctgtcttt

SEQ ID NO: 591438 - DNA, 486 bp, Homo sapiens; identical to SEQ ID NO: 535043
  misc_feature: HIJSMM301EYHU7.46.35.D02.1.454.light.4.raw

SEQ ID NO: 591439 - DNA, 486 bp, Homo sapiens; identical to SEQ ID NO: 535043
  misc_feature: HIJSMM301C2RAM.46.35.D02.1.454.light.4.raw

SEQ ID NO: 591440 - DNA, 509 bp, Homo sapiens; identical to SEQ ID NO: 535670
  misc_feature: HIJSMM301DA5GO.47.23.C01.1.454.light.4.raw

SEQ ID NO: 591441 - DNA, 506 bp, Homo sapiens
  misc_feature: HIJSMM301A1JO3.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggagggaccaaggctgaccgtccttagtcagcccaagg

SEQ ID NO: 591442 - DNA, 446 bp, Homo sapiens; identical to SEQ ID NO: 536034
  misc_feature: HIJSMM301DQ45T.18.9.A09.1.454.light.4.raw

SEQ ID NO: 591443 - DNA, 497 bp, Homo sapiens; identical to SEQ ID NO: 536376
  misc_feature: HIJSMM301EC276.22.9.A09.1.454.light.4.raw

SEQ ID NO: 591444 - DNA, 441 bp, Homo sapiens; identical to SEQ ID NO: 534971
  misc_feature: HIJSMM301BSG1W.11.3.A03.1.454.light.4.raw

SEQ ID NO: 591445 - DNA, 490 bp, Homo sapiens; identical to SEQ ID NO: 543909
  misc_feature: HIJSMM301B4XVP.14.55.E11.1.454.light.4.raw

SEQ ID NO: 591446 - DNA, 512 bp, Homo sapiens
  misc_feature: HIJSMM301DRNCX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccaacgggaccgaaggtaggaaatactaaacgaactagtggtcgtgcgaccatctgtcttcatcttccccg

SEQ ID NO: 591447 - DNA, 495 bp, Homo sapiens; identical to SEQ ID NO: 535596
  misc_feature: HIJSMM301DH5I7.10.79.H02.1.454.light.4.raw

SEQ ID NO: 591448 - DNA, 490 bp, Homo sapiens; identical to SEQ ID NO: 550493
  misc_feature: HIJSMM301EV9AR.10.59.F04.1.454.light.4.raw

SEQ ID NO: 591449 - DNA, 531 bp, Homo sapiens
  misc_feature: HIJSMM301ARWMZ.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagttctgatcgcttctctggctccaagtctggcaccacggcctccctgaccatctctgggctccaggctgaggacgaggctgattatttctgcaagctcaaaaagaagtagccctctcgtggttttcggcgggggccggaaggtagaccgtacctacgtaagcaccaaccggctcgcccctcccggtcgactctcgttcctacccct

SEQ ID NO: 591450 - DNA, 512 bp, Homo sapiens
  misc_feature: HIJSMM301CJOKL.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccgcctcctc

SEQ ID NO: 591451 - DNA, 507 bp, Homo sapiens
  misc_feature: HIJSMM301A2IUK.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaaggtggaaagtcaaacgaactagtggctgcaccatctgtcttctatcttccccg

SEQ ID NO: 591452 - DNA, 493 bp, Homo sapiens
  misc_feature: HIJSMM301B0YAE.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgtac

SEQ ID NO: 591453 - DNA, 472 bp, Homo sapiens; identical to SEQ ID NO: 537757
  misc_feature: HIJSMM301C59KU.51.78.H01.1.454.light.4.raw

SEQ ID NO: 591454 - DNA, 496 bp, Homo sapiens; identical to SEQ ID NO: 536248
  misc_feature: HIJSMM301EDTGU.22.27.C05.1.454.light.4.raw

SEQ ID NO: 591455 - DNA, 446 bp, Homo sapiens; identical to SEQ ID NO: 536400
  misc_feature: HIJSMM301ESKPK.18.9.A09.1.454.light.4.raw

SEQ ID NO: 591456 - DNA, 495 bp, Homo sapiens; identical to SEQ ID NO: 551704
  misc_feature: HIJSMM301EYCTR.13.6.A06.1.454.light.4.raw

SEQ ID NO: 591457 - DNA, 495 bp, Homo sapiens
  misc_feature: HIJSMM301BI63N.41.59.F04.1.454.light.4.raw
tctatactatcacgaccggtgctcgatttagtacacacacttagggattgggggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttatttttgttcaacaggctaataggttccctcaaacattcggccctgggaccagagtggatttgaagcgaactgtggctgcaccatctgtcttcta

SEQ ID NO: 591458 - DNA, 479 bp, Homo sapiens
  misc_feature: HIJSMM301C67GD.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccgaggtggagatcaaacgaactgtgctgcacc

SEQ ID NO: 591459 - DNA, 497 bp, Homo sapiens; identical to SEQ ID NO: 536371
  misc_feature: HIJSMM301A298D.16.78.H01.1.454.light.4.raw

SEQ ID NO: 591460 - DNA, 507 bp, Homo sapiens
  misc_feature: HIJSMM301EUFAV.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggagggaccaagctgaccgtccttagtcagcccaaggcc

SEQ ID NO: 591461 - DNA, 507 bp, Homo sapiens
  misc_feature: HIJSMM301A9JEI.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtca

SEQ ID NO: 591462 - DNA, 491 bp, Homo sapiens
  misc_feature: HIJSMM301CBBD3.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggcctcgccccctcggtcact

SEQ ID NO: 591463 - DNA, 505 bp, Homo sapiens; identical to SEQ ID NO: 571198
  misc_feature: HIJSMM301DN28D.5.86.H09.1.454.light.4.raw

SEQ ID NO: 591464 - DNA, 483 bp, Homo sapiens; identical to SEQ ID NO: 545669
  misc_feature: HIJSMM301CSG08.13.8.A08.1.454.light.4.raw

SEQ ID NO: 591465 - DNA, 511 bp, Homo sapiens; identical to SEQ ID NO: 586829
  misc_feature: HIJSMM301CZSIZ.40.47.E03.1.454.light.4.raw

SEQ ID NO: 591466 - DNA, 507 bp, Homo sapiens; identical to SEQ ID NO: 559853
  misc_feature: HIJSMM301EHNRJ.2.21.B10.1.454.light.4.raw

SEQ ID NO: 591467 - DNA, 496 bp, Homo sapiens; identical to SEQ ID NO: 537925
  misc_feature: HIJSMM301CGBE2.22.14.B03.1.454.light.4.raw

SEQ ID NO: 591468 - DNA, 510 bp, Homo sapiens
  misc_feature: HIJSMM301CKP76.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtcctggtcagcccaaggccaaccccactgtcactctgttcccta

SEQ ID NO: 591469 - DNA, 487 bp, Homo sapiens; identical to SEQ ID NO: 555619
  misc_feature: HIJSMM301C29NB.46.35.D02.1.454.light.4.raw

SEQ ID NO: 591470 - DNA, 502 bp, Homo sapiens
  misc_feature: HIJSMM301ANA8Q.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcactttcggcgggggaccgaaggtggagttcaaacgaactgtggctgcaccatctgtcttctatcttcccg

SEQ ID NO: 591471 - DNA, 489 bp, Homo sapiens
  misc_feature: HIJSMM301BU7D2.43.34.D01.1.454.light.4.raw
tgtgagtagtcacgaccggtgctcgatttagatcgtctgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 591472 - DNA, 481 bp, Homo sapiens; identical to SEQ ID NO: 535993
  misc_feature: HIJSMM301BRQIR.21.25.C03.1.454.light.4.raw

SEQ ID NO: 591473 - DNA, 500 bp, Homo sapiens
  misc_feature: HIJSMM301EQ89B.22.27.C05.1.454.light.4.raw
  modified_base (408)..(408): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgnggcagtttattactgtcagcaatattatattcctcctcagacgttcggccaagggaccaaggtggaaatcaaacgaactgtggctgcaccta

SEQ ID NO: 591474 - DNA, 493 bp, Homo sapiens; identical to SEQ ID NO: 536032
  misc_feature: HIJSMM301BO7HY.22.57.F02.1.454.light.4.raw

SEQ ID NO: 591475 - DNA, 444 bp, Homo sapiens; identical to SEQ ID NO: 535192
  misc_feature: HIJSMM301ETELC.5.9.A09.1.454.light.4.raw

SEQ ID NO: 591476 - DNA, 494 bp, Homo sapiens; identical to SEQ ID NO: 535629
  misc_feature: HIJSMM301CKCPL.4.27.C05.1.454.light.4.raw

SEQ ID NO: 591477 - DNA, 488 bp, Homo sapiens; identical to SEQ ID NO: 553834
  misc_feature: HIJSMM301A9V0T.17.35.D02.1.454.light.4.raw

SEQ ID NO: 591478 - DNA, 489 bp, Homo sapiens; identical to SEQ ID NO: 535091
  misc_feature: HIJSMM301C7VRA.47.36.D03.1.454.light.4.raw

SEQ ID NO: 591479 - DNA, 473 bp, Homo sapiens; identical to SEQ ID NO: 538875
  misc_feature: HIJSMM301BLSPN.4.75.G09.1.454.light.4.raw

SEQ ID NO: 591480 - DNA, 493 bp, Homo sapiens; identical to SEQ ID NO: 535745
  misc_feature: HIJSMM301AVJFG.47.78.H01.1.454.light.4.raw

SEQ ID NO: 591481 - DNA, 496 bp, Homo sapiens
  misc_feature: HIJSMM301CO1Q6.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggct

SEQ ID NO: 591482 - DNA, 518 bp, Homo sapiens
  misc_feature: HIJSMM301C5S7I.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaaccggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctaccg

SEQ ID NO: 591483 - DNA, 488 bp, Homo sapiens
  misc_feature: HIJSMM301DUG03.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcggtgggttttcggcgggagggaccaagctgaccgtcctaggtcacgaccccg

SEQ ID NO: 591484 - DNA, 501 bp, Homo sapiens
  misc_feature: HIJSMM301AMS99.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgagtctgggacagacttcactctcaccatcatcagcctggagcctgaagatgttgcagtttattactgtcaacatcgtaccgagtggcctccggggccactttcggccctgggaccaagtggatatcaaacgaactgtggctgcaccatctgtt

SEQ ID NO: 591485 - DNA, 499 bp, Homo sapiens; identical to SEQ ID NO: 551975
  misc_feature: HIJSMM301DPYPR.41.45.E01.1.454.light.4.raw

SEQ ID NO: 591486 - DNA, 467 bp, Homo sapiens; identical to SEQ ID NO: 558396
  misc_feature: HIJSMM301DNFCZ.3.20.B09.1.454.light.4.raw

SEQ ID NO: 591487 - DNA, 493 bp, Homo sapiens
  misc_feature: HIJSMM301CAUCV.8.19.B08.1.454.light.4.raw
  modified_base (491)..(491): a, c, t, g, unknown or other
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccggggccgaccttcgtcccgtcggaccgaaactaatagtagacaacaaacagtaagcgtgcgcacnct

SEQ ID NO: 591488 - DNA, 510 bp, Homo sapiens
  misc_feature: HIJSMM301COIRA.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaattgagatacaaacgaactagtcggctgcaccactctgtcttcta

SEQ ID NO: 591489 - DNA, 505 bp, Homo sapiens
  misc_feature: HIJSMM301D6C41.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaaggtaggaaatcaaacgaactagtggctgcaccatctgtcttcatcttccccg

SEQ ID NO: 591490 - DNA, 501 bp, Homo sapiens
  misc_feature: HIJSMM301DYTT0.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgtc

SEQ ID NO: 591491 - DNA, 486 bp, Homo sapiens
  misc_feature: HIJSMM301BCYOB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcaggtttattattgtcaacaatattattatacttcgtggacgttcggcaagggaccaaggtagatatcagacgaa

SEQ ID NO: 591492 - DNA, 502 bp, Homo sapiens
  misc_feature: HIJSMM301BQT67.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacataggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 591493 - DNA, 521 bp, Homo sapiens; identical to SEQ ID NO: 539470
  misc_feature: HIJSMM301EOAOI.27.23.C01.1.454.light.4.raw

SEQ ID NO: 591494 - DNA, 492 bp, Homo sapiens; identical to SEQ ID NO: 555820
  misc_feature: HIJSMM301EASUB.22.65.F10.1.454.light.4.raw

SEQ ID NO: 591495 - DNA, 478 bp, Homo sapiens; identical to SEQ ID NO: 555043
  misc_feature: HIJSMM301BWZTG.52.1.A01.1.454.light.4.raw

SEQ ID NO: 591496 - DNA, 511 bp, Homo sapiens
  misc_feature: HIJSMM301A6QDD.15.59.F04.1.454.light.4.raw
  modified_base (499)..(499): a, c, t, g, unknown or other
tctacgtagccacgaccggtgctcgatttagtacacacacttagggattggggggaagcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccacggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtccttatatatgggtgctggcatttcggtcttcggcgggagggaccaagctgaccgtcctaggtcagcccaaggcncgccccctcggt

SEQ ID NO: 591497 - DNA, 482 bp, Homo sapiens
  misc_feature: HIJSMM301CHKIF.46.26.C04.1.454.light.4.raw
  modified_base (431)..(431): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggagctgaggatgttgggctctatattgcatgcaagctntacaagtcccgctcactttcggcggagggaccaaggtggagatcaaacgaa

SEQ ID NO: 591498 - DNA, 419 bp, Homo sapiens; identical to SEQ ID NO: 587500
  misc_feature: HIJSMM301E2WWI.18.78.H01.1.454.light.4.raw

SEQ ID NO: 591499 - DNA, 527 bp, Homo sapiens
  misc_feature: HIJSMM301AFSKO.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggaccgttcgtccgacggaccgaacggtacggaagtacaagacgaactacgtaggtcgtgtcgaccaactctcgttcgttctactcttcccgtcccc

SEQ ID NO: 591500 - DNA, 501 bp, Homo sapiens; identical to SEQ ID NO: 560597
  misc_feature: HIJSMM301CCR3Z.48.87.H10.1.454.light.4.raw

SEQ ID NO: 591501 - DNA, 460 bp, Homo sapiens; identical to SEQ ID NO: 536053
  misc_feature: HIJSMM301CSR7P.22.28.C06.1.454.light.4.raw

SEQ ID NO: 591502 - DNA, 514 bp, Homo sapiens
  misc_feature: HIJSMM301BENZ9.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggtcttttcggtcgggagggaccaagctgaccgtccgtgggtcagcccaacggctcgcccccgtccggtccta

SEQ ID NO: 591503 - DNA, 491 bp, Homo sapiens; identical to SEQ ID NO: 535294
  misc_feature: HIJSMM301EJ9TY.16.68.G02.1.454.light.4.raw

SEQ ID NO: 591504 - DNA, 505 bp, Homo sapiens; identical to SEQ ID NO: 535503
  misc_feature: HIJSMM301BCQHT.8.28.C06.1.454.light.4.raw

SEQ ID NO: 591505 - DNA, 497 bp, Homo sapiens; identical to SEQ ID NO: 535664
  misc_feature: HIJSMM301APUIF.22.14.B03.1.454.light.4.raw

SEQ ID NO: 591506 - DNA, 500 bp, Homo sapiens
  misc_feature: HIJSMM301AQC4Q.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaacggtggaaagtacaaacgaaacctagtggcgtgcgaccctaa

SEQ ID NO: 591507 - DNA, 479 bp, Homo sapiens; identical to SEQ ID NO: 538734
  misc_feature: HIJSMM301BDK3T.8.53.E09.1.454.light.4.raw

SEQ ID NO: 591508 - DNA, 464 bp, Homo sapiens
  misc_feature: HIJSMM301AYYQT.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggccggtgttcggcggagggaccaggctgaccgtcctaagtcagcccaaggctcgccccctcggtcactctgttcccaccctcctcctagtctacg

SEQ ID NO: 591509 - DNA, 482 bp, Homo sapiens; identical to SEQ ID NO: 535352
  misc_feature: HIJSMM301BIQH2.16.81.H04.1.454.light.4.raw

SEQ ID NO: 591510 - DNA, 494 bp, Homo sapiens
  misc_feature: HIJSMM301AOGCB.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaagccaacccactgtcact

SEQ ID NO: 591511 - DNA, 487 bp, Homo sapiens; identical to SEQ ID NO: 569544
  misc_feature: HIJSMM301BSIMM.3.10.A10.1.454.light.4.raw

SEQ ID NO: 591512 - DNA, 463 bp, Homo sapiens; identical to SEQ ID NO: 535062
  misc_feature: HIJSMM301CA1CW.11.73.G07.1.454.light.4.raw

SEQ ID NO: 591513 - DNA, 493 bp, Homo sapiens; identical to SEQ ID NO: 540127
  misc_feature: HIJSMM301AKLTP.10.17.B06.1.454.light.4.raw

SEQ ID NO: 591514 - DNA, 447 bp, Homo sapiens; identical to SEQ ID NO: 535201
  misc_feature: HIJSMM301B5MUK.18.9.A09.1.454.light.4.raw

SEQ ID NO: 591515 - DNA, 505 bp, Homo sapiens
  misc_feature: HIJSMM301E09BO.16.1.A01.1.454.light.4.raw
tgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgcccctcggtcactctgtt

SEQ ID NO: 591516 - DNA, 350 bp, Homo sapiens; identical to SEQ ID NO: 537421
  misc_feature: HIJSMM301DB27J.13.11.A11.1.454.light.4.raw

SEQ ID NO: 591517 - DNA, 444 bp, Homo sapiens; identical to SEQ ID NO: 535192
  misc_feature: HIJSMM301CX7N5.5.9.A09.1.454.light.4.raw

SEQ ID NO: 591518 - DNA, 486 bp, Homo sapiens; identical to SEQ ID NO: 536261
  misc_feature: HIJSMM301BL3W7.26.55.E11.1.454.light.4.raw

SEQ ID NO: 591519 - DNA, 474 bp, Homo sapiens; identical to SEQ ID NO: 552964
  misc_feature: HIJSMM301EV162.15.81.H04.1.454.light.4.raw

SEQ ID NO: 591520 - DNA, 445 bp, Homo sapiens; identical to SEQ ID NO: 542143
  misc_feature: HIJSMM301CJH9K.47.85.H08.1.454.light.4.raw

SEQ ID NO: 591521 - DNA, 488 bp, Homo sapiens
  misc_feature: HIJSMM301CF6B8.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcagcagagtggaggctgaggatgttgggctctattattgcatgcaagctctacaagtcccgctcactttcggcggagggaccgaaggtggagatcaaacgaact

SEQ ID NO: 591522 - DNA, 479 bp, Homo sapiens
  misc_feature: HIJSMM301EYPGJ.9.76.G10.1.454.light.4.raw
  modified_base (443)..(443): a, c, t, g, unknown or other
tgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggnggagggaccaaggctgaccgtcctaggtcagcccaa

SEQ ID NO: 591523 - DNA, 505 bp, Homo sapiens
  misc_feature: HIJSMM301BGY0M.51.59.F04.1.454.light.4.raw
cgatcgtatacacgaccggtgctcgatttagtacacacacttagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagtattttgcagtttattactgtcagcagcgtaacaactggctctctttcggcggagggaccaaggtggagatacaaacgaactgtggctgcaccatctgtcttcatcttcccgccat

SEQ ID NO: 591524 - DNA, 487 bp, Homo sapiens
  misc_feature: HIJSMM301CKWG0.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccagggaaccaaggtggaaagtcaagcgaaactgtgg

SEQ ID NO: 591525 - DNA, 504 bp, Homo sapiens; identical to SEQ ID NO: 574695
  misc_feature: HIJSMM301AWKQ3.48.28.C06.1.454.light.4.raw

SEQ ID NO: 591526 - DNA, 472 bp, Homo sapiens; identical to SEQ ID NO: 535898
  misc_feature: HIJSMM301AK7MD.15.8.A08.1.454.light.4.raw

SEQ ID NO: 591527 - DNA, 505 bp, Homo sapiens; identical to SEQ ID NO: 535503
  misc_feature: HIJSMM301C3DRT.8.28.C06.1.454.light.4.raw

SEQ ID NO: 591528 - DNA, 519 bp, Homo sapiens
  misc_feature: HIJSMM301DZ9MV.27.23.C01.1.454.light.4.raw
  modified_base (509)..(509): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactcngttcccgcct

SEQ ID NO: 591529 - DNA, 446 bp, Homo sapiens; identical to SEQ ID NO: 555110
  misc_feature: HIJSMM301CZ5BO.18.9.A09.1.454.light.4.raw

SEQ ID NO: 591530 - DNA, 509 bp, Homo sapiens; identical to SEQ ID NO: 583983
  misc_feature: HIJSMM301B4D0P.12.48.E04.1.454.light.4.raw

SEQ ID NO: 591531 - DNA, 354 bp, Homo sapiens; identical to SEQ ID NO: 540485
  misc_feature: HIJSMM301CA1WY.40.9.A09.1.454.light.4.raw

SEQ ID NO: 591532 - DNA, 485 bp, Homo sapiens
  misc_feature: HIJSMM301DN20O.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcacctatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 591533 - DNA, 519 bp, Homo sapiens
  misc_feature: HIJSMM301CBUXF.27.23.C01.1.454.light.4.raw
  modified_base (456)..(456): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggngggaccaggctgaccgtcctaggtcagccaaggctcgcccctcggtcactctcgttcccacct

SEQ ID NO: 591534 - DNA, 507 bp, Homo sapiens; identical to SEQ ID NO: 535641
  misc_feature: HIJSMM301ER0ZP.10.88.H11.1.454.light.4.raw

SEQ ID NO: 591535 - DNA, 483 bp, Homo sapiens; identical to SEQ ID NO: 542200
  misc_feature: HIJSMM301DBZBU.7.75.G09.1.454.light.4.raw

SEQ ID NO: 591536 - DNA, 490 bp, Homo sapiens
  misc_feature: HIJSMM301CVZIR.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctggcatagtaatggagacaactatttgggttggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaaacgaactgt

SEQ ID NO: 591537 - DNA, 516 bp, Homo sapiens
  misc_feature: HIJSMM301ESH1N.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaacgggaccgaaggtaggaaagtacaaaacgaaacgtagtggctggcaccatctgtcttctactcttccccg

SEQ ID NO: 591538 - DNA, 482 bp, Homo sapiens; identical to SEQ ID NO: 535796
  misc_feature: HIJSMM301DQ8KR.51.64.F09.1.454.light.4.raw

SEQ ID NO: 591539 - DNA, 497 bp, Homo sapiens; identical to SEQ ID NO: 539058
  misc_feature: HIJSMM301ESTTD.12.87.H10.1.454.light.4.raw

SEQ ID NO: 591540 - DNA, 509 bp, Homo sapiens; identical to SEQ ID NO: 560392
  misc_feature: HIJSMM301D98LG.5.24.C02.1.454.light.4.raw

SEQ ID NO: 591541 - DNA, 518 bp, Homo sapiens; identical to SEQ ID NO: 579925
  misc_feature: HIJSMM301DT713.14.78.H01.1.454.light.4.raw

SEQ ID NO: 591542 - DNA, 508 bp, Homo sapiens
  misc_feature: HIJSMM301BNCPB.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcac

SEQ ID NO: 591543 - DNA, 442 bp, Homo sapiens
  misc_feature: HIJSMM301BG98O.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcgggcggagggacccacgtaaccgtcctaggtcagcccaaggctgccccctcggtcactctgttcccgccctcctcgtatctctcg

SEQ ID NO: 591544 - DNA, 492 bp, Homo sapiens
  misc_feature: HIJSMM301CA8AB.4.22.B11.1.454.light.4.raw
agcactgtagcacgaccggtgctcgatttagacgacagctcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttcttgcatgcaaggtacacactggccgtacacttttggccaggggaccaagctggagatcaaacgaactgtggctgcaccat

SEQ ID NO: 591545 - DNA, 494 bp, Homo sapiens; identical to SEQ ID NO: 534994
  misc_feature: HIJSMM301BPHDZ.27.78.H01.1.454.light.4.raw

SEQ ID NO: 591546 - DNA, 502 bp, Homo sapiens
  misc_feature: HIJSMM301CWQ37.5.86.H09.1.454.light.4.raw
atcagacacgcacgaccggtgctcgatttagtgctatagacttggggtttgggggggtctcaggaggcagcgctctcaggacgtcaccaccatggcctgggctctgcctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtctaggtcagcccaaggctgccccctcgcta

SEQ ID NO: 591547 - DNA, 495 bp, Homo sapiens
  misc_feature: HIJSMM301ERHSS.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcactctcg

SEQ ID NO: 591548 - DNA, 519 bp, Homo sapiens; identical to SEQ ID NO: 547780
  misc_feature: HIJSMM301CR0SI.5.27.C05.1.454.light.4.raw

SEQ ID NO: 591549 - DNA, 489 bp, Homo sapiens; identical to SEQ ID NO: 535091
  misc_feature: HIJSMM301CMYJZ.47.36.D03.1.454.light.4.raw

SEQ ID NO: 591550 - DNA, 508 bp, Homo sapiens
  misc_feature: HIJSMM301AELG4.14.57.F02.1.454.light.4.raw
  modified_base (379)..(379): a, c, t, g, unknown or other
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagngtaaactgaagattttgcagtttattactgtcagcagcggggcaattggccgctcactttcggtcgggggaccgaaggtggagttcaacgaactgtggctgcaccatctgtcttcatcttcccgcccta

SEQ ID NO: 591551 - DNA, 493 bp, Homo sapiens
  misc_feature: HIJSMM301CH45D.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctcgggaccaaac

SEQ ID NO: 591552 - DNA, 503 bp, Homo sapiens; identical to SEQ ID NO: 537189
  misc_feature: HIJSMM301ASLWC.19.85.H08.1.454.light.4.raw

SEQ ID NO: 591553 - DNA, 502 bp, Homo sapiens; identical to SEQ ID NO: 543913
  misc_feature: HIJSMM301AIBKJ.18.26.C04.1.454.light.4.raw

SEQ ID NO: 591554 - DNA, 507 bp, Homo sapiens
  misc_feature: HIJSMM301BAAE2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaaggtggaaagtacaaacgaactagtggctgcaccatctgtcttctatcttccccg

SEQ ID NO: 591555 - DNA, 498 bp, Homo sapiens
  misc_feature: HIJSMM301ASLUO.21.15.B04.1.454.light.4.raw
tcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactacttagcttggtaccagcagcaaccaggacaacgtcctaaattgctcatttactgggcatctgtccgggaatccggggtccctgaccgattcgttggcagcgggtctgggacagatttcactctcaccatcagcagcctacaggctgaagatgtggcagtttatttttgtatgcaacattatgccgctccgctcactttcggcggagggaccaaggtggagatcaaacgaactgtggctgcaccat

SEQ ID NO: 591556 - DNA, 502 bp, Homo sapiens
  misc_feature: HIJSMM301CV22F.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccactgtcactctgttcccaccctcctcta

SEQ ID NO: 591557 - DNA, 480 bp, Homo sapiens
  misc_feature: HIJSMM301CNJZ2.51.60.F05.1.454.light.4.raw
cgatcgtatacacgaccggtgctcgatttagtacgtcatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagcctccctggccatcactgggctccgggctgaggatgaggctgattattactgccagtcccatgacagcagcctgagtgtgctgttcggcggagggaccaagctgaccgtcctacg

SEQ ID NO: 591558 - DNA, 474 bp, Homo sapiens; identical to SEQ ID NO: 558221
  misc_feature: HIJSMM301EKX76.12.49.E05.1.454.light.4.raw

SEQ ID NO: 591559 - DNA, 505 bp, Homo sapiens; identical to SEQ ID NO: 535503
  misc_feature: HIJSMM301EXZIF.8.28.C06.1.454.light.4.raw

SEQ ID NO: 591560 - DNA, 486 bp, Homo sapiens; identical to SEQ ID NO: 537617
  misc_feature: HIJSMM301A3G3Z.10.53.E09.1.454.light.4.raw

SEQ ID NO: 591561 - DNA, 484 bp, Homo sapiens; identical to SEQ ID NO: 535400
  misc_feature: HIJSMM301B4WFZ.46.26.C04.1.454.light.4.raw

SEQ ID NO: 591562 - DNA, 495 bp, Homo sapiens; identical to SEQ ID NO: 538673
  misc_feature: HIJSMM301D819V.51.35.D02.1.454.light.4.raw

SEQ ID NO: 591563 - DNA, 509 bp, Homo sapiens
  misc_feature: HIJSMM301AJZIO.8.42.D09.1.454.light.4.raw
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccct

SEQ ID NO: 591564 - DNA, 443 bp, Homo sapiens
  misc_feature: HIJSMM301BXOED.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctcgtactagag

SEQ ID NO: 591565 - DNA, 489 bp, Homo sapiens
  misc_feature: HIJSMM301AVF9A.21.46.E02.1.454.light.4.raw
tcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgaccgtcctaggtcagcccaaggctgcccctc

SEQ ID NO: 591566 - DNA, 514 bp, Homo sapiens
  misc_feature: HIJSMM301AEHA4.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtcggaccgaacggtggagatcaaacgaactagtggcgtgcaccactctgtcttcta

SEQ ID NO: 591567 - DNA, 503 bp, Homo sapiens; identical to SEQ ID NO: 559148
  misc_feature: HIJSMM301AOSM5.7.31.C09.1.454.light.4.raw

SEQ ID NO: 591568 - DNA, 517 bp, Homo sapiens; identical to SEQ ID NO: 557449
  misc_feature: HIJSMM301CRX27.9.2.A02.1.454.light.4.raw

SEQ ID NO: 591569 - DNA, 519 bp, Homo sapiens
  misc_feature: HIJSMM301CUD4S.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaacagtgacacttgggtgttcggcggagggaccaggctgaccgtcctaggtcagcccaaggctgccccctcggtcactctgttcccgcct

SEQ ID NO: 591570 - DNA, 524 bp, Homo sapiens
  misc_feature: HIJSMM301EHXYP.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactggacgaaggtacaccgtcctaggtcagccaacggaccaaccccacctgtcactctgttcccgccctccctccgtcgtc

SEQ ID NO: 591571 - DNA, 511 bp, Homo sapiens
  misc_feature: HIJSMM301ALNP3.8.28.C06.1.454.light.4.raw
ctcgcgtgtccacgaccggtgctcgatttagagctcacgtattgggtttgggggaggaactgctcagttaggacccagacggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtcgggaccgaaggtggagatcaaacgaactgtggctgcaccatctgtcttcta

SEQ ID NO: 591572 - DNA, 503 bp, Homo sapiens; identical to SEQ ID NO: 547049
  misc_feature: HIJSMM301DD5D8.18.59.F04.1.454.light.4.raw

SEQ ID NO: 591573 - DNA, 485 bp, Homo sapiens; identical to SEQ ID NO: 535688
  misc_feature: HIJSMM301AY9KI.19.5.A05.1.454.light.4.raw

SEQ ID NO: 591574 - DNA, 520 bp, Homo sapiens; identical to SEQ ID NO: 558881
  misc_feature: HIJSMM301CBSZI.27.23.C01.1.454.light.4.raw
  modified_base (516)..(516): a, c, t, g, unknown or other

SEQ ID NO: 591575 - DNA, 503 bp, Homo sapiens
  misc_feature: HIJSMM301CC3A4.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagcccaggttcagtggcagtggggtctggggacagagttcactctcaccatcagcagcctgcagtctgaagattttgcagtttattattgtcagcagtataataactggcctccgtggacgttcgccaagggaccaaggtggaaatacaaacgaactagtggctgcaccatctgtcttcta

SEQ ID NO: 591576 - DNA, 484 bp, Homo sapiens; identical to SEQ ID NO: 535400
  misc_feature: HIJSMM301EIXEV.46.26.C04.1.454.light.4.raw

SEQ ID NO: 591577 - DNA, 487 bp, Homo sapiens; identical to SEQ ID NO: 536206
  misc_feature: HIJSMM301C0ZER.47.38.D05.1.454.light.4.raw

SEQ ID NO: 591578 - DNA, 492 bp, Homo sapiens; identical to SEQ ID NO: 538317
  misc_feature: HIJSMM301EPZT8.10.17.B06.1.454.light.4.raw

SEQ ID NO: 591579 - DNA, 484 bp, Homo sapiens; identical to SEQ ID NO: 535400
  misc_feature: HIJSMM301BWWIW.46.26.C04.1.454.light.4.raw

SEQ ID NO: 591580 - DNA, 454 bp, Homo sapiens
  misc_feature: HIJSMM301BKK5R.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgcgaacggtccggttttcggcggagggaccaagctgaccgtcctaagtcagcccaaggctgccccctcggtcactctgttcccaccctcctccacgagagta

SEQ ID NO: 591581 - DNA, 493 bp, Homo sapiens
  misc_feature: HIJSMM301B6Q7P.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggacggagatcagacgaactgtggcgtgcaccatctgtcttcta

SEQ ID NO: 591582 - DNA, 482 bp, Homo sapiens
  misc_feature: HIJSMM301ARSB3.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctcctgaccatctctgggctccaggctgaggatgaggctgattattactgctgctcatatgcaggcagctacacttgggtgttcggcggagggaccaagctgaccgtcctaggtcacgcccaa

SEQ ID NO: 591583 - DNA, 509 bp, Homo sapiens
  misc_feature: HIJSMM301AS2Q9.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctcgccccctcggtcactctgttcccta

SEQ ID NO: 591584 - DNA, 472 bp, Homo sapiens; identical to SEQ ID NO: 537757
  misc_feature: HIJSMM301DZGTT.51.78.H01.1.454.light.4.raw

SEQ ID NO: 591585 - DNA, 474 bp, Homo sapiens; identical to SEQ ID NO: 561309
  misc_feature: HIJSMM301AFK4X.5.12.B01.1.454.light.4.raw

SEQ ID NO: 591586 - DNA, 505 bp, Homo sapiens; identical to SEQ ID NO: 563076
  misc_feature: HIJSMM301EPHWF.47.55.E11.1.454.light.4.raw

SEQ ID NO: 591587 - DNA, 512 bp, Homo sapiens
  misc_feature: HIJSMM301ADOPY.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccgaagactgaccgtcctcggtcagcccaaggctgccccctcggt

SEQ ID NO: 591588 - DNA, 485 bp, Homo sapiens
  misc_feature: HIJSMM301BDSXG.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccgggtccctgacaggttcagtggcagtggatcaggcacagattttacactgaaaatcagcagagtggaggctgaggatgttgggctctattattgcatgcaagctctacaagtcccgctcactttcggcggagggaccgaaggtggagatacaaacgaa

SEQ ID NO: 591589 - DNA, 506 bp, Homo sapiens
  misc_feature: HIJSMM301EWJF5.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaagggaccaaggtggaaagtcaaacgaactagtggctgcaccat

SEQ ID NO: 591590 - DNA, 478 bp, Homo sapiens; identical to SEQ ID NO: 535129
  misc_feature: HIJSMM301DOX6C.11.11.A11.1.454.light.4.raw

SEQ ID NO: 591591 - DNA, 507 bp, Homo sapiens
  misc_feature: HIJSMM301D5H3R.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactgagcctgaagattttgcagtgtattactgtcagcagtatggtagctcacggacgttcggccaagggaccgaaggtggaaagtcaaacgaactacgtggctgcaccatctgtcttcatcttccccg

SEQ ID NO: 591592 - DNA, 497 bp, Homo sapiens; identical to SEQ ID NO: 560526
  misc_feature: HIJSMM301DGHZ7.40.65.F10.1.454.light.4.raw

SEQ ID NO: 591593 - DNA, 461 bp, Homo sapiens
  misc_feature: HIJSMM301BH72X.47.60.F05.1.454.light.4.raw
  modified_base (442)..(442): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagttattactgtcagcatatcatgactgccgctcacttcgcaggacngactgagataagaacatgg

SEQ ID NO: 591594 - DNA, 454 bp, Homo sapiens; identical to SEQ ID NO: 536846
  misc_feature: HIJSMM301CEVKJ.18.78.H01.1.454.light.4.raw

SEQ ID NO: 591595 - DNA, 477 bp, Homo sapiens
  misc_feature: HIJSMM301BBD9Y.48.75.G09.1.454.light.4.raw
agtatacatacacgaccggtgctcgatttagtatagacatcaggggactgatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctccatacacttttggcccggggaccaaggtggatctcaaagaa

SEQ ID NO: 591596 - DNA, 511 bp, Homo sapiens
  misc_feature: HIJSMM301CAH5S.48.87.H10.1.454.light.4.raw
agtatacatacacgaccggtgctcgatttagcagtactgcgttgggtttgggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgtattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgcctcct

SEQ ID NO: 591597 - DNA, 504 bp, Homo sapiens; identical to SEQ ID NO: 566644
  misc_feature: HIJSMM301B6150.8.28.C06.1.454.light.4.raw

SEQ ID NO: 591598 - DNA, 487 bp, Homo sapiens; identical to SEQ ID NO: 536206
  misc_feature: HIJSMM301DFAD8.47.38.D05.1.454.light.4.raw

SEQ ID NO: 591599 - DNA, 511 bp, Homo sapiens
  misc_feature: HIJSMM301CA20D.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccggggccacgtttcggccctcgggaccaacggtggagatcaaacgaactgtggctgcaccatctgtcttcta

SEQ ID NO: 591600 - DNA, 506 bp, Homo sapiens
  misc_feature: HIJSMM301A38C2.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccactgtcta

SEQ ID NO: 591601 - DNA, 514 bp, Homo sapiens
  misc_feature: HIJSMM301BFJUM.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgacgtattactgtcaggtgtgggataatggtggtgatcatccggtcttcggcggagggaccaaagttgaccgtcctaagtcagcccaaggctgccccctcggtcactctgttcccgccctcctca

SEQ ID NO: 591602 - DNA, 508 bp, Homo sapiens
  misc_feature: HIJSMM301C760L.51.57.F02.1.454.light.4.raw
cgatcgtatacacgaccggtgctcgatttagctcgatatagttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggtttattactgcatgcaaggtacacactggcctgggacgttcggccaagggaccaaggtggaaatcaaacgaactgtggctgcaccatctgtcttcta

SEQ ID NO: 591603 - DNA, 488 bp, Homo sapiens; identical to SEQ ID NO: 535990
  misc_feature: HIJSMM301D8M7V.11.28.C06.1.454.light.4.raw

SEQ ID NO: 591604 - DNA, 497 bp, Homo sapiens
  misc_feature: HIJSMM301CMAZP.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtggggcgcggcgttttcggcgggggacggacggtaggacgatacaacgaaactgttggcgtgcaccactctgtt

SEQ ID NO: 591605 - DNA, 503 bp, Homo sapiens; identical to SEQ ID NO: 565187
  misc_feature: HIJSMM301BNTAJ.16.49.E05.1.454.light.4.raw

SEQ ID NO: 591606 - DNA, 487 bp, Homo sapiens; identical to SEQ ID NO: 538190
  misc_feature: HIJSMM301C92VK.47.70.G04.1.454.light.4.raw

SEQ ID NO: 591607 - DNA, 493 bp, Homo sapiens
  misc_feature: HIJSMM301D3O64.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacacgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaggaccgaaggtggaaatcaacgaactgtgctgcac

SEQ ID NO: 591608 - DNA, 498 bp, Homo sapiens
  misc_feature: HIJSMM301AN9OB.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctcgccccctcggt

SEQ ID NO: 591609 - DNA, 478 bp, Homo sapiens
  misc_feature: HIJSMM301COYK3.49.83.H06.1.454.light.4.raw
agtcgagagacacgaccggtgctcgatttagatcacgtgcgtcgcggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtcccatcaaggttcagtggaagtggatctgggacgtattttactttctaccatcatcaacctgcagcctgaggatattgcaacatattactgtcaacaatatgataatctaccactcactttcggcggaggaccacggtggagatcaaacgaactagtggctgc

SEQ ID NO: 591610 - DNA, 509 bp, Homo sapiens
  misc_feature: HIJSMM301EK0SO.51.55.E11.1.454.light.4.raw
cgatcgtatacacgaccggtgctcgatttagcactcgcacgttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttcta

SEQ ID NO: 591611 - DNA, 507 bp, Homo sapiens
  misc_feature: HIJSMM301B15H2.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcgggcggagggaccaagctgaccgtcctaggtcagcccaaggctgccccctcggtcactctgttcccaccctcctcg

SEQ ID NO: 591612 - DNA, 495 bp, Homo sapiens; identical to SEQ ID NO: 588904
  misc_feature: HIJSMM301B6AV3.11.81.H04.1.454.light.4.raw

SEQ ID NO: 591613 - DNA, 503 bp, Homo sapiens
  misc_feature: HIJSMM301AUQGW.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttacctttcggtcggagggaccgaaggtggagatcaaacgaactagtggctgcaccatctgtcttcatcttccccg

SEQ ID NO: 591614 - DNA, 487 bp, Homo sapiens; identical to SEQ ID NO: 536536
  misc_feature: HIJSMM301AG405.26.45.E01.1.454.light.4.raw

SEQ ID NO: 591615 - DNA, 496 bp, Homo sapiens
  misc_feature: HIJSMM301A26MO.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccggccagcagtggtaacattgtgatattcggcggagggaccaaggtgaccgtcctacgtcagcccaaggctgccccctcggtcactctcg

SEQ ID NO: 591616 - DNA, 508 bp, Homo sapiens; identical to SEQ ID NO: 555366
  misc_feature: HIJSMM301D3N7B.47.85.H08.1.454.light.4.raw

SEQ ID NO: 591617 - DNA, 507 bp, Homo sapiens; identical to SEQ ID NO: 535930
  misc_feature: HIJSMM301DPCTD.15.34.D01.1.454.light.4.raw

SEQ ID NO: 591618 - DNA, 497 bp, Homo sapiens
  misc_feature: HIJSMM301ADG2R.26.12.B01.1.454.light.4.raw
  modified_base (480)..(480): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggcccagattcagtggcagggggtctgggacagaattcactctcaccatcaccagcctgcagtctgaagattttgcagtctattactgtcagcaatataattactggctctctttcggcgggggccgaagctggagatcaaccgaaactntggctgcaccatctgtt

SEQ ID NO: 591619 - DNA, 510 bp, Homo sapiens
  misc_feature: HIJSMM301CZE03.48.5.A05.1.454.light.4.raw
agtatacatacacgaccggtgctcgatttagatagatagacagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgatgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcgggacccagaccctggagcctcagttgaaagcagccgatccagcctgcggagccgtgtgggcaggtcagcccaaggcccaacccactcgtcactcttccg

SEQ ID NO: 591620 - DNA, 486 bp, Homo sapiens
  misc_feature: HIJSMM301D3R7P.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaaactggatatcagacgaactgtgg

SEQ ID NO: 591621 - DNA, 515 bp, Homo sapiens
  misc_feature: HIJSMM301CG58C.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgtcggctattatgtgcagtggttccagcagcgcccgggcagtgcccccaccagagtgatctatgaggataacctacggccctctggggtccctcctcggttttctggctccatcgacgggtcctccactactgccctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 591622 - DNA, 505 bp, Homo sapiens; identical to SEQ ID NO: 586297
  misc_feature: HIJSMM301ETFDB.8.28.C06.1.454.light.4.raw

SEQ ID NO: 591623 - DNA, 500 bp, Homo sapiens
  misc_feature: HIJSMM301A42VC.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatcaaacgaaactgtggctgcaccatctgtcttcta

SEQ ID NO: 591624 - DNA, 507 bp, Homo sapiens
  misc_feature: HIJSMM301AZ1G8.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtgacacatttttcttggtttttggcggcgggacccagatgactgtcctcagtcagcccaaggctgccccctcggt

SEQ ID NO: 591625 - DNA, 490 bp, Homo sapiens
  misc_feature: HIJSMM301AZB9C.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgttgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtctt

SEQ ID NO: 591626 - DNA, 516 bp, Homo sapiens; identical to SEQ ID NO: 586396
  misc_feature: HIJSMM301AQNOP.12.85.H08.1.454.light.4.raw

SEQ ID NO: 591627 - DNA, 513 bp, Homo sapiens
  misc_feature: HIJSMM301DUFK4.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtctaggtcagcccaaggctgccccctcggtcactctgttccccg

SEQ ID NO: 591628 - DNA, 501 bp, Homo sapiens; identical to SEQ ID NO: 536867
  misc_feature: HIJSMM301CJEUY.5.86.H09.1.454.light.4.raw

SEQ ID NO: 591629 - DNA, 491 bp, Homo sapiens
  misc_feature: HIJSMM301ADQJE.48.51.E07.1.454.light.4.raw
agtatacatacacgaccggtgctcgatttagcatactctacaacacacaaagggggaagacaatgggtttgatttagattacatgggtgacttttctgttttatttccaatctcagataccaccggagaaattgtgttgacgcagtctttaggcaccctgtctttgtctccagggaaagagccaccctctcctgcagggccagtcagactgttagcagcagctactgagcctggtaccagctgaaacctggccaggctcccctgctcctcatctatggtgcatccagcagggccactggcatcccagacaggttcagtggcagtgggtctgggacagacttcactctcaccatcttcagactggagcctgaagattttgcagtgtattactgtcagcagtatggtaactcaacggaggacttttggccaggggaccaagctggagatcaaacgaactgtggctgcaccatctgtcttcatcttcccgccat

SEQ ID NO: 591630 - DNA, 486 bp, Homo sapiens; identical to SEQ ID NO: 535043
  misc_feature: HIJSMM301AQRMT.46.35.D02.1.454.light.4.raw

SEQ ID NO: 591631 - DNA, 488 bp, Homo sapiens
  misc_feature: HIJSMM301ET1CD.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactaggacatcaaacgaactagtgctgcaccatctgtt

SEQ ID NO: 591632 - DNA, 509 bp, Homo sapiens; identical to SEQ ID NO: 541829
  misc_feature: HIJSMM301CZPW8.17.28.C06.1.454.light.4.raw

SEQ ID NO: 591633 - DNA, 485 bp, Homo sapiens; identical to SEQ ID NO: 536075
  misc_feature: HIJSMM301BMI8M.17.21.B10.1.454.light.4.raw

SEQ ID NO: 591634 - DNA, 480 bp, Homo sapiens
  misc_feature: HIJSMM301ES43C.41.15.B04.1.454.light.4.raw
tctatactatcacgaccggtgctcgatttagacagtatatatccgcgggcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcatagtataga

SEQ ID NO: 591635 - DNA, 485 bp, Homo sapiens; identical to SEQ ID NO: 539041
  misc_feature: HIJSMM301EDV2W.46.26.C04.1.454.light.4.raw

SEQ ID NO: 591636 - DNA, 494 bp, Homo sapiens
  misc_feature: HIJSMM301BWH4W.14.55.E11.1.454.light.4.raw
  modified_base (458)..(458): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacctttcggcggagggaccaaggcggagatnacccccgagaactgtggctgcaccatctgtcttcta

SEQ ID NO: 591637 - DNA, 476 bp, Homo sapiens
  misc_feature: HIJSMM301DQFGK.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttggcggagggaccaagctgaccgtctaagtcagcccg

SEQ ID NO: 591638 - DNA, 487 bp, Homo sapiens
  misc_feature: HIJSMM301DMRTG.4.57.F02.1.454.light.4.raw
agcactgtagcacgaccggtgctcgatttagctcgatatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgataccctccgctcactttcgcggagggaccaaggtggagatcaaacgaactgtggctgcaccact

SEQ ID NO: 591639 - DNA, 506 bp, Homo sapiens
  misc_feature: HIJSMM301A7HAC.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctggaccgtcctaggtcagcccaaggctgccccctcggtcactctgttcccaccctcctcg

SEQ ID NO: 591640 - DNA, 454 bp, Homo sapiens; identical to SEQ ID NO: 534964
  misc_feature: HIJSMM301ERBKI.19.86.H09.1.454.light.4.raw

SEQ ID NO: 591641 - DNA, 481 bp, Homo sapiens
  misc_feature: HIJSMM301AR7JB.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagtattttgcaacttattactgtcaacaggtttatatttaccctcgttattttcggccctgggaccacagtagatatcaaacgaactgtggctgcacc

SEQ ID NO: 591642 - DNA, 491 bp, Homo sapiens
  misc_feature: HIJSMM301D3Z1D.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccgagggtggacgtcaaacgaactgtggctgcacatctgtcttcat

SEQ ID NO: 591643 - DNA, 481 bp, Homo sapiens; identical to SEQ ID NO: 535314
  misc_feature: HIJSMM301CEPEX.10.4.A04.1.454.light.4.raw

SEQ ID NO: 591644 - DNA, 485 bp, Homo sapiens
  misc_feature: HIJSMM301DGFCF.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccaaagtggacgtcaaacgaactgtggctgcacca

SEQ ID NO: 591645 - DNA, 499 bp, Homo sapiens; identical to SEQ ID NO: 541506
  misc_feature: HIJSMM301AT565.51.38.D05.1.454.light.4.raw

SEQ ID NO: 591646 - DNA, 513 bp, Homo sapiens
  misc_feature: HIJSMM301E3P9D.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgtcgtcgaacggaccgaacggtaggaaagtacaaaacgaactaagtggcgtgcaccatctcgtcttctactcttccccg

SEQ ID NO: 591647 - DNA, 447 bp, Homo sapiens; identical to SEQ ID NO: 535201
  misc_feature: HIJSMM301ATG3C.18.9.A09.1.454.light.4.raw

SEQ ID NO: 591648 - DNA, 499 bp, Homo sapiens; identical to SEQ ID NO: 536030
  misc_feature: HIJSMM301BNXQX.48.23.C01.1.454.light.4.raw

SEQ ID NO: 591649 - DNA, 505 bp, Homo sapiens
  misc_feature: HIJSMM301B5969.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctctaagtgatcaaccttcggccaagggacacgactggagattaaaacg

SEQ ID NO: 591650 - DNA, 487 bp, Homo sapiens; identical to SEQ ID NO: 536536
  misc_feature: HIJSMM301A5L9U.26.45.E01.1.454.light.4.raw

SEQ ID NO: 591651 - DNA, 506 bp, Homo sapiens
  misc_feature: HIJSMM301D39MM.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacaggacttcactctcaccatcatcagcctggagcctgaagatgttgcagtttattactgtcaacatcgtaccgagtggcctccgggggccactttcggccctcgggaccaaagtggatatcaaacgaactgtggctgcaccatctgtt

SEQ ID NO: 591652 - DNA, 493 bp, Homo sapiens
  misc_feature: HIJSMM301ESR27.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgtccccccg

SEQ ID NO: 591653 - DNA, 496 bp, Homo sapiens
  misc_feature: HIJSMM301ALQQ4.47.78.H01.1.454.light.4.raw
agctcacgtacacgaccggtgctcgatttagtgtgagtagtttgggtttggggtgatcaggactcctcagttcaccttctcacaatggggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcaccatctgtcttcta

SEQ ID NO: 591654 - DNA, 511 bp, Homo sapiens; identical to SEQ ID NO: 546062
  misc_feature: HIJSMM301D9BCU.5.58.F03.1.454.light.4.raw

SEQ ID NO: 591655 - DNA, 496 bp, Homo sapiens
  misc_feature: HIJSMM301AZDZJ.48.70.G04.1.454.light.4.raw
agtatacatacacgaccggtgctcgatttagtgtagtgtgaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagactttttagtttacgttcggaccttcggtccaacgggacacgactggagattaaacgaacta

SEQ ID NO: 591656 - DNA, 497 bp, Homo sapiens; identical to SEQ ID NO: 536371
  misc_feature: HIJSMM301BLGQX.16.78.H01.1.454.light.4.raw

SEQ ID NO: 591657 - DNA, 494 bp, Homo sapiens; identical to SEQ ID NO: 543242
  misc_feature: HIJSMM301D9R12.27.78.H01.1.454.light.4.raw
  modified_base (462)..(462): a, c, t, g, unknown or other

SEQ ID NO: 591658 - DNA, 527 bp, Homo sapiens
  misc_feature: HIJSMM301CQKW6.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctggtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaacccccactcgtcactctcgttcccaccctccctccgtgt

SEQ ID NO: 591659 - DNA, 555 bp, Homo sapiens
  misc_feature: HIJSMM301BZOH7.15.78.H01.1.454.light.4.raw
tctacgtagccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctccccctacccaacaacgcataagcgtcgctgccgcagcttcggtgcatggtttagcccccgtttcatcttcccgccatctgagctacgtagac

SEQ ID NO: 591660 - DNA, 519 bp, Homo sapiens
  misc_feature: HIJSMM301BS8GY.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 591661 - DNA, 489 bp, Homo sapiens; identical to SEQ ID NO: 535139
  misc_feature: HIJSMM301AFTT3.14.55.E11.1.454.light.4.raw

SEQ ID NO: 591662 - DNA, 496 bp, Homo sapiens
  misc_feature: HIJSMM301DSV9C.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacgaactgtggctgcaccatctgtt

SEQ ID NO: 591663 - DNA, 484 bp, Homo sapiens; identical to SEQ ID NO: 551470
  misc_feature: HIJSMM301B3VZU.10.1.A01.1.454.light.4.raw

SEQ ID NO: 591664 - DNA, 530 bp, Homo sapiens
  misc_feature: HIJSMM301AXZ4Z.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcgaggtcacgacccgaacggacccaaccccactcgtacactcttcccg

SEQ ID NO: 591665 - DNA, 485 bp, Homo sapiens; identical to SEQ ID NO: 538053
  misc_feature: HIJSMM301EDTUZ.13.5.A05.1.454.light.4.raw

SEQ ID NO: 591666 - DNA, 487 bp, Homo sapiens; identical to SEQ ID NO: 536206
  misc_feature: HIJSMM301CDOP4.47.38.D05.1.454.light.4.raw

SEQ ID NO: 591667 - DNA, 444 bp, Homo sapiens; identical to SEQ ID NO: 535027
  misc_feature: HIJSMM301ECASM.8.73.G07.1.454.light.4.raw

SEQ ID NO: 591668 - DNA, 494 bp, Homo sapiens; identical to SEQ ID NO: 534992
  misc_feature: HIJSMM301BVTPF.9.1.A01.1.454.light.4.raw

SEQ ID NO: 591669 - DNA, 505 bp, Homo sapiens
  misc_feature: HIJSMM301EL8XS.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctgcccccg

SEQ ID NO: 591670 - DNA, 491 bp, Homo sapiens; identical to SEQ ID NO: 563782
  misc_feature: HIJSMM301D2080.10.17.B06.1.454.light.4.raw

SEQ ID NO: 591671 - DNA, 495 bp, Homo sapiens
  misc_feature: HIJSMM301BF22T.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccacctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttatactgtcagcagtataataactggcctccacggtacacttttggccaggggaccaagctggagatcaaacgaactgtggctgcaccatctgtt

SEQ ID NO: 591672 - DNA, 497 bp, Homo sapiens
  misc_feature: HIJSMM301D5878.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattgtgcactatattactgtcagctttatgttaattcacctccgtcgtacatctttggccaggggaccaagctggagatcaaacgaactgtggctgcaccatctgtcttcatt

SEQ ID NO: 591673 - DNA, 484 bp, Homo sapiens; identical to SEQ ID NO: 535240
  misc_feature: HIJSMM301DVC1O.47.60.F05.1.454.light.4.raw

SEQ ID NO: 591674 - DNA, 491 bp, Homo sapiens
  misc_feature: HIJSMM301BQZUK.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctggattccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgt

SEQ ID NO: 591675 - DNA, 497 bp, Homo sapiens
  misc_feature: HIJSMM301AET0R.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagccctgcaggctgaagatgtggcagtttattactgtcagcaatattatagtactcctccgaggctcacttcggcggagggaccaaggtaggagatacaacgaactgt

SEQ ID NO: 591676 - DNA, 496 bp, Homo sapiens
  misc_feature: HIJSMM301CQVK6.49.26.C04.1.454.light.4.raw
agtcgagagacacgaccggtgctcgatttagtctagcgactttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 591677 - DNA, 495 bp, Homo sapiens; identical to SEQ ID NO: 535596
  misc_feature: HIJSMM301CEETS.10.79.H02.1.454.light.4.raw

SEQ ID NO: 591678 - DNA, 490 bp, Homo sapiens
  misc_feature: HIJSMM301AT3GZ.3.10.A10.1.454.light.4.raw
agacgcactccacgaccggtgctcgatttagcgtcgatctcagggggtgggtccaggaggcagaactctgggtgtcccaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccactgt

SEQ ID NO: 591679 - DNA, 510 bp, Homo sapiens
  misc_feature: HIJSMM301D4XPW.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactatttctgtcaggtgtgggctactcgcagtgacctctgcgtcttcggaagtgggaccaaggtcaccgtcttaggtcagcccaaggccaaccccactgtcactctgttcccgccct

SEQ ID NO: 591680 - DNA, 463 bp, Homo sapiens; identical to SEQ ID NO: 535062
  misc_feature: HIJSMM301CLEFF.11.73.G07.1.454.light.4.raw

SEQ ID NO: 591681 - DNA, 502 bp, Homo sapiens; identical to SEQ ID NO: 536774
  misc_feature: HIJSMM301DOF2M.14.57.F02.1.454.light.4.raw

SEQ ID NO: 591682 - DNA, 496 bp, Homo sapiens
  misc_feature: HIJSMM301A8GNB.48.31.C09.1.454.light.4.raw
agtatacatacacgaccggtgctcgattagacgtctcatcaaggaaggaagggggcaggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtctt

SEQ ID NO: 591683 - DNA, 485 bp, Homo sapiens
  misc_feature: HIJSMM301DTSPY.49.77.G11.1.454.light.4.raw
agtcgagagacacgaccggtgctcgatttagctagtcactcaagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatcttcccgccat

SEQ ID NO: 591684 - DNA, 508 bp, Homo sapiens
  misc_feature: HIJSMM301EMOEA.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcact

SEQ ID NO: 591685 - DNA, 505 bp, Homo sapiens; identical to SEQ ID NO: 539292
  misc_feature: HIJSMM301BSKQ5.19.85.H08.1.454.light.4.raw

SEQ ID NO: 591686 - DNA, 509 bp, Homo sapiens; identical to SEQ ID NO: 536047
  misc_feature: HIJSMM301BMHBS.17.33.C11.1.454.light.4.raw

SEQ ID NO: 591687 - DNA, 498 bp, Homo sapiens; identical to SEQ ID NO: 550538
  misc_feature: HIJSMM301AVS00.52.29.C07.1.454.light.4.raw

SEQ ID NO: 591688 - DNA, 486 bp, Homo sapiens; identical to SEQ ID NO: 535043
  misc_feature: HIJSMM301CD7MU.46.35.D02.1.454.light.4.raw

SEQ ID NO: 591689 - DNA, 488 bp, Homo sapiens
  misc_feature: HIJSMM301DCNYR.3.72.G06.1.454.light.4.raw
agacgcactccacgaccggtgctcgatttagctacgactgcaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtgagagacagcgtcaccatcacttgccgggcaagtcaaagcattagcacttatttgaattggtttcggcagaaaccggggacagcccctgagctcctgatctataaagcatccaatttgcaaactggggtcccatcaaggttcagtggcagtggatctgggacacatttcactctcaccatcagcaatctgcaacctgaagattttgcaacttactactgtcaacagagttttagtccccagtggacgttcggccaagggaccagggtggaaatcaaacgaactgtggctgcaccatctgt

SEQ ID NO: 591690 - DNA, 483 bp, Homo sapiens; identical to SEQ ID NO: 565854
  misc_feature: HIJSMM301DBCUT.13.59.F04.1.454.light.4.raw

SEQ ID NO: 591691 - DNA, 447 bp, Homo sapiens; identical to SEQ ID NO: 535201
  misc_feature: HIJSMM301EYTRU.18.9.A09.1.454.light.4.raw

SEQ ID NO: 591692 - DNA, 512 bp, Homo sapiens
  misc_feature: HIJSMM301CTOUU.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccaccctcctcgagtagtaca

SEQ ID NO: 591693 - DNA, 485 bp, Homo sapiens
  misc_feature: HIJSMM301D36O5.17.34.D01.1.454.light.4.raw
cgtagactagcacgaccggtgctcgatttagatcgtctgtgttggggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgactagtctacg

SEQ ID NO: 591694 - DNA, 464 bp, Homo sapiens
  misc_feature: HIJSMM301EBGNS.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacaggtccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 591695 - DNA, 508 bp, Homo sapiens
  misc_feature: HIJSMM301DVKJ9.43.3.A03.1.454.light.4.raw
tgtgagtagtcacgaccggtgctcgatttagagagcgtcacaggggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgttcccg

SEQ ID NO: 591696 - DNA, 434 bp, Homo sapiens
  misc_feature: HIJSMM301AOB14.48.22.B11.1.454.light.4.raw
agtatacatacacgaccggtgctcgatttagacgacagctcagggcaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccgccatctgatatgtatact

SEQ ID NO: 591697 - DNA, 506 bp, Homo sapiens
  misc_feature: HIJSMM301A8DN1.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcctgcc

SEQ ID NO: 591698 - DNA, 514 bp, Homo sapiens
  misc_feature: HIJSMM301C1HJ4.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcctagtctacg

SEQ ID NO: 591699 - DNA, 493 bp, Homo sapiens; identical to SEQ ID NO: 540179
  misc_feature: HIJSMM301AY4YT.27.78.H01.1.454.light.4.raw

SEQ ID NO: 591700 - DNA, 505 bp, Homo sapiens
  misc_feature: HIJSMM301DQXW2.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactttgtt

SEQ ID NO: 591701 - DNA, 488 bp, Homo sapiens
  misc_feature: HIJSMM301DCJ3M.49.82.H05.1.454.light.4.raw
agtcgagagacacgaccggtgctcgatttagtcgagctctctcgcggcacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgaccg

SEQ ID NO: 591702 - DNA, 509 bp, Homo sapiens
  misc_feature: HIJSMM301BAG5S.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataaccctatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgagggtgattatttctgcagctcatttacaaccagccacaccttgctcttcggaactgggaccacggtcatcgtcctaggtcagcccaaggccaacccactgtcact

SEQ ID NO: 591703 - DNA, 486 bp, Homo sapiens; identical to SEQ ID NO: 535043
  misc_feature: HIJSMM301BEAT4.46.35.D02.1.454.light.4.raw

SEQ ID NO: 591704 - DNA, 490 bp, Homo sapiens
  misc_feature: HIJSMM301EGL0K.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcaatactatagtcctcctctcacgttcggcggagggaccaaggtggagatcaaacgaactgtggctgcaccatctgtcttcatcttcccgcc

SEQ ID NO: 591705 - DNA, 475 bp, Homo sapiens
  misc_feature: HIJSMM301BM3PG.5.28.C06.1.454.light.4.raw
atcagacacgcacgaccggtgctcgatttagagctcacgtattgggtttggggagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtaatgatagtctggccgccttcggcggagggaccaaggtggagatcgaacgaactgtggctgcacc

SEQ ID NO: 591706 - DNA, 492 bp, Homo sapiens; identical to SEQ ID NO: 564874
  misc_feature: HIJSMM301C2B2S.11.25.C03.1.454.light.4.raw

SEQ ID NO: 591707 - DNA, 486 bp, Homo sapiens; identical to SEQ ID NO: 535290
  misc_feature: HIJSMM301ETARB.3.12.B01.1.454.light.4.raw

SEQ ID NO: 591708 - DNA, 497 bp, Homo sapiens; identical to SEQ ID NO: 536371
  misc_feature: HIJSMM301BNVQV.16.78.H01.1.454.light.4.raw

SEQ ID NO: 591709 - DNA, 497 bp, Homo sapiens
  misc_feature: HIJSMM301CN2LS.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctcgtaggagacagagtcaccatcacttgtcgggccagtcagaatattaatagttggttggcctggtatcagcagaaaccagggaaagccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggcccaagggacacggactggagattaaacgaactgtggctgcaccatctgtcttcatt

SEQ ID NO: 591710 - DNA, 487 bp, Homo sapiens; identical to SEQ ID NO: 535704
  misc_feature: HIJSMM301C7IPB.52.83.H06.1.454.light.4.raw

SEQ ID NO: 591711 - DNA, 454 bp, Homo sapiens; identical to SEQ ID NO: 536347
  misc_feature: HIJSMM301BAWYN.19.86.H09.1.454.light.4.raw

SEQ ID NO: 591712 - DNA, 496 bp, Homo sapiens
  misc_feature: HIJSMM301EMGKT.52.86.H09.1.454.light.4.raw
cgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 591713 - DNA, 487 bp, Homo sapiens; identical to SEQ ID NO: 537208
  misc_feature: HIJSMM301AEZI9.3.55.E11.1.454.light.4.raw

SEQ ID NO: 591714 - DNA, 509 bp, Homo sapiens
  misc_feature: HIJSMM301DTG5S.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccg

SEQ ID NO: 591715 - DNA, 486 bp, Homo sapiens; identical to SEQ ID NO: 536323
  misc_feature: HIJSMM301B4U03.10.2.A02.1.454.light.4.raw

SEQ ID NO: 591716 - DNA, 454 bp, Homo sapiens; identical to SEQ ID NO: 535005
  misc_feature: HIJSMM301BS9WD.19.86.H09.1.454.light.4.raw

SEQ ID NO: 591717 - DNA, 505 bp, Homo sapiens; identical to SEQ ID NO: 546412
  misc_feature: HIJSMM301D2MTP.22.21.B10.1.454.light.4.raw

SEQ ID NO: 591718 - DNA, 492 bp, Homo sapiens; identical to SEQ ID NO: 534967
  misc_feature: HIJSMM301DPXU4.47.64.F09.1.454.light.4.raw

SEQ ID NO: 591719 - DNA, 510 bp, Homo sapiens
  misc_feature: HIJSMM301DSGRX.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcgggagggaccaaactgaccgtcctaggtcagcccaaggctgccccctcgtcactctcg

SEQ ID NO: 591720 - DNA, 512 bp, Homo sapiens
  misc_feature: HIJSMM301CSF7R.13.53.E09.1.454.light.4.raw
  modified_base (449)..(449): a, c, t, g, unknown or other
  modified_base (502)..(502): a, c, t, g, unknown or other
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagatttaccctcaccatcaggggtctacagcctgaagaatttgtcgacttactattgttcaacagagttaccttcttcccccggacccgtcgtcncgacgacgaggaagtaagagaacgaacgacgtacggagtcgcgacgacactanacgttctctt

SEQ ID NO: 591721 - DNA, 496 bp, Homo sapiens
  misc_feature: HIJSMM301ASHT5.18.59.F04.1.454.light.4.raw
tacgagtatgcacgaccggtgctcgatttagtacacacacttagggattgggggcgtggggtctcaggaggcagcgctctcgggacgtctccaccatggcctgggctctgctattcctcaccctcctcactcagggcacagggtcctgggcccagtctgccctgactcagtctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcaccgtctaggtcagcccaagg

SEQ ID NO: 591722 - DNA, 448 bp, Homo sapiens
  misc_feature: HIJSMM301BQ5UB.18.73.G07.1.454.light.4.raw
tacgagtatgcacgaccggtgctcgatttagctctacgctcagggtcctgggcccagtctgggctgacgcagccgccctcactgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctcgttccccgccctcctccatactcgta

SEQ ID NO: 591723 - DNA, 485 bp, Homo sapiens
  misc_feature: HIJSMM301D97MQ.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgctaacttactactgtcagcaggctaacaggctcgcccccaaccttcggccaggggacacgactggagataaacgaactgtggctgcaccatct

SEQ ID NO: 591724 - DNA, 493 bp, Homo sapiens; identical to SEQ ID NO: 535745
  misc_feature: HIJSMM301D1KAL.47.78.H01.1.454.light.4.raw

SEQ ID NO: 591725 - DNA, 505 bp, Homo sapiens
  misc_feature: HIJSMM301EV5M3.49.82.H05.1.454.light.4.raw
agtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgtttcatatgccggtgatagtggccgaagggtggttcggcggagggaccaaggtgaccgtcctaggtcagcccaaggctgccccctcggt

SEQ ID NO: 591726 - DNA, 447 bp, Homo sapiens; identical to SEQ ID NO: 535201
  misc_feature: HIJSMM301DHJB6.18.9.A09.1.454.light.4.raw

SEQ ID NO: 591727 - DNA, 516 bp, Homo sapiens
  misc_feature: HIJSMM301B11JS.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccccg

SEQ ID NO: 591728 - DNA, 482 bp, Homo sapiens
  misc_feature: HIJSMM301ATTDA.4.27.C05.1.454.light.4.raw
agcactgtagcacgaccggtgctcgatttagacgcgatcgaagggtttgggggatcaggactcctcagttcaccttctcacaatgaggctccctgctcagctcctggggctgctaatgctctgggtctctggatccagtggggatattgtgatgactcagtctccactctccctgcccgtcacccttggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaa

SEQ ID NO: 591729 - DNA, 502 bp, Homo sapiens
  misc_feature: HIJSMM301EYBQU.51.87.H10.1.454.light.4.raw
cgatcgtatacacgaccggtgctcgatttagcagtactgcgttgggtttggggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctggtccactctgttccccg

SEQ ID NO: 591730 - DNA, 484 bp, Homo sapiens; identical to SEQ ID NO: 535211
  misc_feature: HIJSMM301DTAAG.47.46.E02.1.454.light.4.raw

SEQ ID NO: 591731 - DNA, 505 bp, Homo sapiens
  misc_feature: HIJSMM301BV39M.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 591732 - DNA, 484 bp, Homo sapiens; identical to SEQ ID NO: 550726
  misc_feature: HIJSMM301CFO7L.47.62.F07.1.454.light.4.raw

SEQ ID NO: 591733 - DNA, 490 bp, Homo sapiens
  misc_feature: HIJSMM301ETKUV.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatacaaacgaactagtggctgcaccat

SEQ ID NO: 591734 - DNA, 448 bp, Homo sapiens; identical to SEQ ID NO: 540364
  misc_feature: HIJSMM301BMPCN.18.9.A09.1.454.light.4.raw

SEQ ID NO: 591735 - DNA, 475 bp, Homo sapiens; identical to SEQ ID NO: 560950
  misc_feature: HIJSMM301BLKU7.5.12.B01.1.454.light.4.raw

SEQ ID NO: 591736 - DNA, 494 bp, Homo sapiens
  misc_feature: HIJSMM301CVZVW.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtaccaagtaacttttggccgagggaccaagctggagatacaaacgaactgtggctgcaccactcttc

SEQ ID NO: 591737 - DNA, 494 bp, Homo sapiens; identical to SEQ ID NO: 534994
  misc_feature: HIJSMM301CPVLF.27.78.H01.1.454.light.4.raw

SEQ ID NO: 591738 - DNA, 512 bp, Homo sapiens
  misc_feature: HIJSMM301ALI38.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactctgtt

SEQ ID NO: 591739 - DNA, 480 bp, Homo sapiens
  misc_feature: HIJSMM301ES3EW.16.81.H04.1.454.light.4.raw
tgtactactccacgaccggtgctcgatttagtagtgtagattcgcgggggagtcagactcagtcaggacacagcatggacatgagggtccccgctcagctcctgggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgcaacagtataagagttattcaactttcggtccctgggaccaatgtggatatcaaacgaactgtgctgcaccatctgtt

SEQ ID NO: 591740 - DNA, 500 bp, Homo sapiens
  misc_feature: HIJSMM301CISDU.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcgggcgggggaccacgactgaccgtcctaggtcagcccaaggctgcccctcggtcactctgttcccgccctcctccactactatg

SEQ ID NO: 591741 - DNA, 489 bp, Homo sapiens; identical to SEQ ID NO: 535386
  misc_feature: HIJSMM301EGC6U.12.51.E07.1.454.light.4.raw

SEQ ID NO: 591742 - DNA, 447 bp, Homo sapiens; identical to SEQ ID NO: 535201
  misc_feature: HIJSMM301EUUNX.18.9.A09.1.454.light.4.raw

SEQ ID NO: 591743 - DNA, 492 bp, Homo sapiens; identical to SEQ ID NO: 568542
  misc_feature: HIJSMM301AOYC2.10.17.B06.1.454.light.4.raw

SEQ ID NO: 591744 - DNA, 520 bp, Homo sapiens; identical to SEQ ID NO: 537173
  misc_feature: HIJSMM301BPYCO.27.23.C01.1.454.light.4.raw

SEQ ID NO: 591745 - DNA, 516 bp, Homo sapiens
  misc_feature: HIJSMM301EHPJ9.49.17.B06.1.454.light.4.raw
agtcgagagacacgaccggtgctcgatttagtcgatagtgaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctgccccctcggtcactctgttcccaccctcct

SEQ ID NO: 591746 - DNA, 497 bp, Homo sapiens; identical to SEQ ID NO: 581850
  misc_feature: HIJSMM301D8XAV.49.6.A06.1.454.light.4.raw

SEQ ID NO: 591747 - DNA, 494 bp, Homo sapiens; identical to SEQ ID NO: 543242
  misc_feature: HIJSMM301C1S1W.27.78.H01.1.454.light.4.raw
  modified_base (462)..(462): a, c, t, g, unknown or other

SEQ ID NO: 591748 - DNA, 493 bp, Homo sapiens
  misc_feature: HIJSMM301DCOOK.49.78.H01.1.454.light.4.raw
agtcgagagacacgaccggtgctcgatttagtgtgagtagtttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgtt

SEQ ID NO: 591749 - DNA, 511 bp, Homo sapiens
  misc_feature: HIJSMM301AWY8Y.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgccccctc

SEQ ID NO: 591750 - DNA, 473 bp, Homo sapiens; identical to SEQ ID NO: 535262
  misc_feature: HIJSMM301CV1H8.8.67.G01.1.454.light.4.raw

SEQ ID NO: 591751 - DNA, 491 bp, Homo sapiens
  misc_feature: HIJSMM301B6KEG.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgtggggtttattactgcatgcaagctctacaaactccttacacttttggccaggggaccaagctggaggatcaaacgaactgt

SEQ ID NO: 591752 - DNA, 486 bp, Homo sapiens; identical to SEQ ID NO: 535043
  misc_feature: HIJSMM301DI2YP.46.35.D02.1.454.light.4.raw

SEQ ID NO: 591753 - DNA, 464 bp, Homo sapiens
  misc_feature: HIJSMM301A80HN.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaaggacacgactggagattaacgaa

SEQ ID NO: 591754 - DNA, 503 bp, Homo sapiens; identical to SEQ ID NO: 538884
  misc_feature: HIJSMM301A8QIC.27.78.H01.1.454.light.4.raw

SEQ ID NO: 591755 - DNA, 492 bp, Homo sapiens; identical to SEQ ID NO: 534967
  misc_feature: HIJSMM301BAODT.47.64.F09.1.454.light.4.raw

SEQ ID NO: 591756 - DNA, 466 bp, Homo sapiens
  misc_feature: HIJSMM301D09HT.48.23.C01.1.454.light.4.raw
agtatacatacacgaccggtgctcgatttagtacacgtgattagggattgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagatttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 591757 - DNA, 502 bp, Homo sapiens; identical to SEQ ID NO: 589004
  misc_feature: HIJSMM301BBN8X.19.85.H08.1.454.light.4.raw

SEQ ID NO: 591758 - DNA, 506 bp, Homo sapiens
  misc_feature: HIJSMM301D1ZVN.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtgaggctgaggatgttggggtttattactgcatgcaaactacacacggccgctcactttcggcggagggaccgaaggtggagatcaaacgaactgtggctgcaccatctgtt

SEQ ID NO: 591759 - DNA, 495 bp, Homo sapiens
  misc_feature: HIJSMM301DWBG9.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgacttgggttttattcactttcggccctgggaccaaagtggtatttcagacgaactgtggctgcaccatctgtcttcta

SEQ ID NO: 591760 - DNA, 521 bp, Homo sapiens; identical to SEQ ID NO: 539470
  misc_feature: HIJSMM301DVINJ.27.23.C01.1.454.light.4.raw

SEQ ID NO: 591761 - DNA, 445 bp, Homo sapiens; identical to SEQ ID NO: 542143
  misc_feature: HIJSMM301DGQ1P.47.85.H08.1.454.light.4.raw

SEQ ID NO: 591762 - DNA, 509 bp, Homo sapiens
  misc_feature: HIJSMM301EJO7S.53.71.G05.1.454.light.4.raw
cgcgtatacacacgaccggtgctcgatttagtgtcgtcgcaagagagagggggagtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagttgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctcgtt

SEQ ID NO: 591763 - DNA, 504 bp, Homo sapiens
  misc_feature: HIJSMM301EQCT0.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccgaagctgaccgtctacgtcagcccaaggctgccccctcggtcactctgttccccg

SEQ ID NO: 591764 - DNA, 504 bp, Homo sapiens
  misc_feature: HIJSMM301EY5IX.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctcctgaccgtctctgggctccaagctgaggatgaggctgattattactgcagctcatatgcaggcagcagcaatgtacttttcggcggagggaccaagctgaccgtcctgggtcagcccaaggctcgccccctcggtcta

SEQ ID NO: 591765 - DNA, 447 bp, Homo sapiens
  misc_feature: HIJSMM301EF2D1.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggcccatcactgggctccaggctgaggatgaggctgactattactgccagtcctatgacatgaggctgagtggttcgatgtcttcggatctgggaccaaggtcaccgtcctaagtcagcccaaggccaacccctctgtcactctgttcccacctcctccatactcgta

SEQ ID NO: 591766 - DNA, 510 bp, Homo sapiens
  misc_feature: HIJSMM301A7D6O.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaaccaagctgaccgtcctaggtcagcccaaggctgccccctcggtcactctgtt

SEQ ID NO: 591767 - DNA, 486 bp, Homo sapiens
  misc_feature: HIJSMM301B1R1I.49.14.B03.1.454.light.4.raw
agtcgagagacacgaccggtgctcgatttagtgtgagtagttccgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacagtatgatagtctcccgctcactttcggcgggggaccgaaggtggagatcaagcgaactgtggctgcaccatctgtt

SEQ ID NO: 591768 - DNA, 496 bp, Homo sapiens; identical to SEQ ID NO: 553382
  misc_feature: HIJSMM301DEQ2N.51.59.F04.1.454.light.4.raw

SEQ ID NO: 591769 - DNA, 483 bp, Homo sapiens
  misc_feature: HIJSMM301D0K8T.17.34.D01.1.454.light.4.raw
cgtagactagcacgaccggtgctcgatttagatcgtctgtgttgggtttgggtcgatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttaatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttctccgacgttcggccaagggaccaaggtggaactcaaacgaactgtggctgcacatctgtcttcatcttccgccatctgactagtctacg

SEQ ID NO: 591770 - DNA, 517 bp, Homo sapiens
  misc_feature: HIJSMM301AUQQH.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtcctcggtcagcccaaggctcgccccctcggtcactctgttcccaccctcctc

SEQ ID NO: 591771 - DNA, 512 bp, Homo sapiens
  misc_feature: HIJSMM301DOJ9P.22.27.C05.1.454.light.4.raw
  modified_base (423)..(423): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactntcagcaattattatacttcctcctcagtaccgttcggaccgaagggaccgaaggtaggaaatacaaacgaactggtggctgccacctac

SEQ ID NO: 591772 - DNA, 485 bp, Homo sapiens; identical to SEQ ID NO: 570096
  misc_feature: HIJSMM301B3XP5.46.35.D02.1.454.light.4.raw

SEQ ID NO: 591773 - DNA, 474 bp, Homo sapiens; identical to SEQ ID NO: 574375
  misc_feature: HIJSMM301ECCFE.18.76.G10.1.454.light.4.raw

SEQ ID NO: 591774 - DNA, 511 bp, Homo sapiens
  misc_feature: HIJSMM301AQWOY.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaaggctgccccctcggtcactctgttcccta

SEQ ID NO: 591775 - DNA, 520 bp, Homo sapiens
  misc_feature: HIJSMM301BK287.22.30.C08.1.454.light.4.raw
  modified_base (506)..(506): a, c, t, g, unknown or other
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctgggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccnccctcctcacgtcg

SEQ ID NO: 591776 - DNA, 482 bp, Homo sapiens
  misc_feature: HIJSMM301EC69T.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggaccctgggaccaatgtggatatcaaacgaactgtggctgcaccatctgt

SEQ ID NO: 591777 - DNA, 522 bp, Homo sapiens
  misc_feature: HIJSMM301AS1JD.27.23.C01.1.454.light.4.raw
  modified_base (519)..(519): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattaattgtagttcatatacaaccagtgacacttgggtgttcggcggagggaccaggctgaccgtcctaggtcagcccaaaggctgccccctcggtcactctgttcccncct

SEQ ID NO: 591778 - DNA, 509 bp, Homo sapiens; identical to SEQ ID NO: 559299
  misc_feature: HIJSMM301CPAXE.17.28.C06.1.454.light.4.raw

SEQ ID NO: 591779 - DNA, 496 bp, Homo sapiens; identical to SEQ ID NO: 535109
  misc_feature: HIJSMM301B6925.16.78.H01.1.454.light.4.raw

SEQ ID NO: 591780 - DNA, 503 bp, Homo sapiens
  misc_feature: HIJSMM301CJIDU.8.28.C06.1.454.light.4.raw
ctcgcgtgtccacgaccggtgctcgatttagagctcacgtattgggtttggggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgactgtggctgcacatctgtcttcatcttcccgccat

SEQ ID NO: 591781 - DNA, 494 bp, Homo sapiens; identical to SEQ ID NO: 534992
  misc_feature: HIJSMM301DPHTL.9.1.A01.1.454.light.4.raw

SEQ ID NO: 591782 - DNA, 502 bp, Homo sapiens
  misc_feature: HIJSMM301DAJ6I.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatcaacaaaaaccagggaaagcccctaaatacctggtctatactgcatccactttgcaaagtgggtcccatcaaggttcagtggcagtggatttgggacagttttcactctcacaatcagcagtctgaacctgaagattttgcaacttactactgtcaacagacttacaatataccgaggacgttcggtcaagggaccaaggtggagatcaaacgaaactgtggctgcaccatctgtcttcatcttccgccat

SEQ ID NO: 591783 - DNA, 514 bp, Homo sapiens
  misc_feature: HIJSMM301A7M3Z.18.26.C04.1.454.light.4.raw
tacgagtatgcacgaccggtgctcgatttagtctagcgacttttggggtttgggggggtcgagacccacgtcgggacacagcatggacatgagggtccccgcctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggtcggagggaccgaaggtaagagatcaaaggaaacgtgtggctgcaccatctgtcttcactcttcccgtccca

SEQ ID NO: 591784 - DNA, 488 bp, Homo sapiens; identical to SEQ ID NO: 544442
  misc_feature: HIJSMM301A2K2D.19.57.F02.1.454.light.4.raw

SEQ ID NO: 591785 - DNA, 520 bp, Homo sapiens
  misc_feature: HIJSMM301BUN89.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctcgccccctcggtcactctcgttcccgaccctcctccacg

SEQ ID NO: 591786 - DNA, 504 bp, Homo sapiens
  misc_feature: HIJSMM301B1Z9T.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgactgtggctgcaccatctgtcttcatcttcccgcc

SEQ ID NO: 591787 - DNA, 489 bp, Homo sapiens
  misc_feature: HIJSMM301AIK5A.47.70.G04.1.454.light.4.raw
  modified_base (486)..(486): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactagtggctgcaccatcngtt

SEQ ID NO: 591788 - DNA, 515 bp, Homo sapiens
  misc_feature: HIJSMM301ED1ZE.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtccactctgttcccaccctcctca

SEQ ID NO: 591789 - DNA, 506 bp, Homo sapiens
  misc_feature: HIJSMM301AOSHO.43.23.C01.1.454.light.4.raw
tgtgagtagtcacgaccggtgctcgatttagtacacgtgatttgggattgggaacctatgaacattctgtaggggccactgtcttctccacggtgctcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaaggctgaccgtcctgggtca

SEQ ID NO: 591790 - DNA, 479 bp, Homo sapiens; identical to SEQ ID NO: 535118
  misc_feature: HIJSMM301B7DR6.13.59.F04.1.454.light.4.raw

SEQ ID NO: 591791 - DNA, 454 bp, Homo sapiens; identical to SEQ ID NO: 536347
  misc_feature: HIJSMM301ANKLB.19.86.H09.1.454.light.4.raw

SEQ ID NO: 591792 - DNA, 525 bp, Homo sapiens
  misc_feature: HIJSMM301AD5K6.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcaggcgggttgggtggttcgggccggggggaccgacactgaccgtcctaggtcacgcccaacggctcgccccctccggtccactctcgtt

SEQ ID NO: 591793 - DNA, 519 bp, Homo sapiens
  misc_feature: HIJSMM301DPZWP.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtcactctgttcccaccctcctccacg

SEQ ID NO: 591794 - DNA, 506 bp, Homo sapiens
  misc_feature: HIJSMM301DIQ7C.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcagggtccctggccgattctctggctccaagtctggcgcctcagccaccctggccatcagtgggctccggcccgaggatgaggctgattatactgtgtaggttgggatcgcagcctgactgcttacgtcttcggagctgggaccaaggtcaccgtctaggtcagcccaaggccaaccccac

SEQ ID NO: 591795 - DNA, 490 bp, Homo sapiens
  misc_feature: HIJSMM301C40J9.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgctaacttattactgccaacagtataatggttatgaatccacttttggccaagggaccaagctggagatcaaacgaactgtaggctgcacc

SEQ ID NO: 591796 - DNA, 494 bp, Homo sapiens; identical to SEQ ID NO: 535680
  misc_feature: HIJSMM301DNHZ9.16.78.H01.1.454.light.4.raw

SEQ ID NO: 591797 - DNA, 501 bp, Homo sapiens
  misc_feature: HIJSMM301A7N2F.40.71.G05.1.454.light.4.raw
tctagcgactcacgaccggtgctcgatttagtgtcgtcgcaagagagagggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcctaggtcagcccg

SEQ ID NO: 591798 - DNA, 520 bp, Homo sapiens
  misc_feature: HIJSMM301A07U8.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctagaagtattttgctagtttattactgtcagcagtaattaattacgtcggccgtcggtacgttcggaccgaacgggaaccgaaggtagggtaagtacgaaaccgaaactagtggtcgtcgccaccactctcgttctt

SEQ ID NO: 591799 - DNA, 474 bp, Homo sapiens
  misc_feature: HIJSMM301AHSV7.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatctagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 591800 - DNA, 495 bp, Homo sapiens; identical to SEQ ID NO: 542299
  misc_feature: HIJSMM301ETJ61.22.86.H09.1.454.light.4.raw

SEQ ID NO: 591801 - DNA, 488 bp, Homo sapiens; identical to SEQ ID NO: 535081
  misc_feature: HIJSMM301A91C2.26.23.C01.1.454.light.4.raw

SEQ ID NO: 591802 - DNA, 473 bp, Homo sapiens
  misc_feature: HIJSMM301ELM89.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcatcagcgggctccagtctgaggactctgcaacttattactgccaacaatatgatatttattctccagcgttcggccaggggaccaaggtggaagtcaagcgaa

SEQ ID NO: 591803 - DNA, 511 bp, Homo sapiens; identical to SEQ ID NO: 544123
  misc_feature: HIJSMM301CC7NZ.5.27.C05.1.454.light.4.raw

SEQ ID NO: 591804 - DNA, 498 bp, Homo sapiens; identical to SEQ ID NO: 537020
  misc_feature: HIJSMM301EJDC9.26.26.C04.1.454.light.4.raw

SEQ ID NO: 591805 - DNA, 501 bp, Homo sapiens; identical to SEQ ID NO: 555551
  misc_feature: HIJSMM301BXKQ4.21.81.H04.1.454.light.4.raw

SEQ ID NO: 591806 - DNA, 496 bp, Homo sapiens
  misc_feature: HIJSMM301BWBGF.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattacttgcatgcaagctctacaaactacctctcactttcggtcggagggaccgaaggtaggagagtacaaacgaactacgt

SEQ ID NO: 591807 - DNA, 493 bp, Homo sapiens
  misc_feature: HIJSMM301C2C32.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgactaagtccagccacaatcttttatacagttccaacaatgaaaactacttagcttggtaccagcagagaccaggacagcctcctaggctgctcatttactgggcatctacccgggaatccggggtccctgaccgattcagtggcaggcgggtctgggacagatttcattctcaccatcagcagcctgcaggctgaagatgtggcagtttattattgtcaacaatattattactacttcgtggacgttcggccaagggaccaaaggtggatatcagacgaa

SEQ ID NO: 591808 - DNA, 491 bp, Homo sapiens
  misc_feature: HIJSMM301CQWP6.3.10.A10.1.454.light.4.raw
agacgcactccacgaccggtgctcgatttagcgtcgatctcagggggctgtgggtccaggaggcagaactctgggtgtctcaccatggcctggatccctctaccttctccccctcctcactctctgcacagactctgaggcctcctatgagctgacacagccaccctcggtgtcagtgtccccaggacagacggccaagatcacctgctctggagatgcattgccaaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccc

SEQ ID NO: 591809 - DNA, 445 bp, Homo sapiens; identical to SEQ ID NO: 582720
  misc_feature: HIJSMM301CYELU.9.9.A09.1.454.light.4.raw

SEQ ID NO: 591810 - DNA, 454 bp, Homo sapiens
  misc_feature: HIJSMM301BTA44.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaaggctgaccgtcctaagtcagcgcaaggctgccccctcggtcactctgttcccgccctcctccacgagagta

SEQ ID NO: 591811 - DNA, 463 bp, Homo sapiens
  misc_feature: HIJSMM301EPJ7G.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaattttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaacgaa

SEQ ID NO: 591812 - DNA, 511 bp, Homo sapiens
  misc_feature: HIJSMM301AT922.48.14.B03.1.454.light.4.raw
agtatacatacacgaccggtgctcgatttagtgtgagtagttccgcgggcggtgctcgatttagtagtgtagattccgcgggcacgaccggtgctcgatttagagtgagctcgttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgtacgg

SEQ ID NO: 591813 - DNA, 515 bp, Homo sapiens
  misc_feature: HIJSMM301EYL8J.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtccactctgttccccg

SEQ ID NO: 591814 - DNA, 504 bp, Homo sapiens; identical to SEQ ID NO: 538940
  misc_feature: HIJSMM301CSM6X.2.35.D02.1.454.light.4.raw

SEQ ID NO: 591815 - DNA, 489 bp, Homo sapiens; identical to SEQ ID NO: 544819
  misc_feature: HIJSMM301C0E83.11.28.C06.1.454.light.4.raw

SEQ ID NO: 591816 - DNA, 517 bp, Homo sapiens
  misc_feature: HIJSMM301DQRPI.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcgggcggaggcaccgaagtgaccgtcctcggtcagcccaaggctgccccctcggtcactctcg

SEQ ID NO: 591817 - DNA, 445 bp, Homo sapiens; identical to SEQ ID NO: 575408
  misc_feature: HIJSMM301EJ35H.47.85.H08.1.454.light.4.raw
  modified_base (427)..(427): a, c, t, g, unknown or other

SEQ ID NO: 591818 - DNA, 491 bp, Homo sapiens; identical to SEQ ID NO: 540281
  misc_feature: HIJSMM301BKTWE.19.71.G05.1.454.light.4.raw

SEQ ID NO: 591819 - DNA, 484 bp, Homo sapiens; identical to SEQ ID NO: 536162
  misc_feature: HIJSMM301DH19M.13.59.F04.1.454.light.4.raw

SEQ ID NO: 591820 - DNA, 493 bp, Homo sapiens
  misc_feature: HIJSMM301DQGYA.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaaacagagttacacgtacccccctcacctttcggcggagggacccaaggcggagatcagacgaactgtggctgcaccatctgtcttcta

SEQ ID NO: 591821 - DNA, 508 bp, Homo sapiens
  misc_feature: HIJSMM301EWWJM.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaataagaggtacaaacgaactagtggcgtgcaccatctgtcttctatt

SEQ ID NO: 591822 - DNA, 491 bp, Homo sapiens; identical to SEQ ID NO: 536693
  misc_feature: HIJSMM301A51R7.19.83.H06.1.454.light.4.raw

SEQ ID NO: 591823 - DNA, 506 bp, Homo sapiens
  misc_feature: HIJSMM301AOID2.22.15.B04.1.454.light.4.raw
acatacgcgtcacgaccggtgctcgatttagacagtatatatccgcggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtccta

SEQ ID NO: 591824 - DNA, 480 bp, Homo sapiens
  misc_feature: HIJSMM301A2RSJ.48.2.A02.1.454.light.4.raw
agtatacatacacgaccggtgctcgatttagactcatctacaggggggagccagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccaggggaccgaaagtggatgtcaaccgaactgtggctgcaccta

SEQ ID NO: 591825 - DNA, 492 bp, Homo sapiens; identical to SEQ ID NO: 541395
  misc_feature: HIJSMM301ETQV2.21.47.E03.1.454.light.4.raw

SEQ ID NO: 591826 - DNA, 490 bp, Homo sapiens
  misc_feature: HIJSMM301BVAOE.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccatcttcg

SEQ ID NO: 591827 - DNA, 501 bp, Homo sapiens; identical to SEQ ID NO: 535746
  misc_feature: HIJSMM301APLWB.18.11.A11.1.454.light.4.raw

SEQ ID NO: 591828 - DNA, 483 bp, Homo sapiens
  misc_feature: HIJSMM301EXOXM.4.1.A01.1.454.light.4.raw
agcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcta

SEQ ID NO: 591829 - DNA, 513 bp, Homo sapiens; identical to SEQ ID NO: 535244
  misc_feature: HIJSMM301C1UJN.17.33.C11.1.454.light.4.raw

SEQ ID NO: 591830 - DNA, 478 bp, Homo sapiens; identical to SEQ ID NO: 535129
  misc_feature: HIJSMM301C5VZC.11.11.A11.1.454.light.4.raw

SEQ ID NO: 591831 - DNA, 476 bp, Homo sapiens
  misc_feature: HIJSMM301CV8CB.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagtacccg

SEQ ID NO: 591832 - DNA, 448 bp, Homo sapiens; identical to SEQ ID NO: 579599
  misc_feature: HIJSMM301A8SDV.18.9.A09.1.454.light.4.raw

SEQ ID NO: 591833 - DNA, 484 bp, Homo sapiens; identical to SEQ ID NO: 535211
  misc_feature: HIJSMM301CK6BM.47.46.E02.1.454.light.4.raw

SEQ ID NO: 591834 - DNA, 453 bp, Homo sapiens; identical to SEQ ID NO: 536065
  misc_feature: HIJSMM301EG02Q.18.78.H01.1.454.light.4.raw

SEQ ID NO: 591835 - DNA, 510 bp, Homo sapiens
  misc_feature: HIJSMM301EUL4H.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttctatctttcccgcc

SEQ ID NO: 591836 - DNA, 508 bp, Homo sapiens
  misc_feature: HIJSMM301CSOC9.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggctgccccccg

SEQ ID NO: 591837 - DNA, 506 bp, Homo sapiens
  misc_feature: HIJSMM301CUL44.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtccaccgtcctaggtcagcccaaggccaaaccccactgtca

SEQ ID NO: 591838 - DNA, 505 bp, Homo sapiens; identical to SEQ ID NO: 535503
  misc_feature: HIJSMM301EDNLZ.8.28.C06.1.454.light.4.raw

SEQ ID NO: 591839 - DNA, 499 bp, Homo sapiens
  misc_feature: HIJSMM301CI8MA.43.53.E09.1.454.light.4.raw
tgtgagtagtcacgaccggtgctcgatttagagagagtgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccta

SEQ ID NO: 591840 - DNA, 499 bp, Homo sapiens
  misc_feature: HIJSMM301CP9BG.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagccaaggctgccccctcggtccactctcg

SEQ ID NO: 591841 - DNA, 487 bp, Homo sapiens
  misc_feature: HIJSMM301C7NN7.51.6.A06.1.454.light.4.raw
cgatcgtatacacgaccggtgctcgatttagatctactgacaggggggggagcctagctgtgctgtgggtccaggaggcagaactctgggtgtctcaccatggcctggatccctctacttctccccctcctcactctctgcacaggctctgaggcctcctatgtgctgacacagccacctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtctaggtcagcccaac

SEQ ID NO: 591842 - DNA, 507 bp, Homo sapiens; identical to SEQ ID NO: 583819
  misc_feature: HIJSMM301BQ2ZM.8.42.D09.1.454.light.4.raw

SEQ ID NO: 591843 - DNA, 498 bp, Homo sapiens; identical to SEQ ID NO: 535469
  misc_feature: HIJSMM301D57H9.12.18.B07.1.454.light.4.raw

SEQ ID NO: 591844 - DNA, 461 bp, Homo sapiens
  misc_feature: HIJSMM301AI9QA.10.9.A09.1.454.light.4.raw
catagtagtgcacgaccggtgctcgatttagcgagacgcgcagggggaggaactgctcagttaggacccagagggaaccatggaagccccagctcagcatctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaagtggagatcaaacgaactgtggctgcaccatctgtcttcatcttcccgccatctgacactactatg

SEQ ID NO: 591845 - DNA, 494 bp, Homo sapiens; identical to SEQ ID NO: 534992
  misc_feature: HIJSMM301A6CV9.9.1.A01.1.454.light.4.raw

SEQ ID NO: 591846 - DNA, 512 bp, Homo sapiens
  misc_feature: HIJSMM301C5G1D.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcactt

SEQ ID NO: 591847 - DNA, 513 bp, Homo sapiens; identical to SEQ ID NO: 552442
  misc_feature: HIJSMM301APYPI.47.85.H08.1.454.light.4.raw

SEQ ID NO: 591848 - DNA, 510 bp, Homo sapiens
  misc_feature: HIJSMM301A1C0L.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctcgttcccg

SEQ ID NO: 591849 - DNA, 492 bp, Homo sapiens
  misc_feature: HIJSMM301C8M0G.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaactagtttcccgctccaccgttcggcggagggaccaaggtggagatgaaaagaactgtggctgcaccat

SEQ ID NO: 591850 - DNA, 487 bp, Homo sapiens; identical to SEQ ID NO: 543137
  misc_feature: HIJSMM301BGFSQ.40.83.H06.1.454.light.4.raw

SEQ ID NO: 591851 - DNA, 494 bp, Homo sapiens; identical to SEQ ID NO: 564757
  misc_feature: HIJSMM301EJPTC.51.81.H04.1.454.light.4.raw

SEQ ID NO: 591852 - DNA, 499 bp, Homo sapiens
  misc_feature: HIJSMM301D9WOC.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggaccgttcggccgacgggaccgacggtcggagtgtctaagacgaactagtggtcgtcgcgaccatcttcg

SEQ ID NO: 591853 - DNA, 487 bp, Homo sapiens; identical to SEQ ID NO: 536206
  misc_feature: HIJSMM301ERR4G.47.38.D05.1.454.light.4.raw

SEQ ID NO: 591854 - DNA, 495 bp, Homo sapiens; identical to SEQ ID NO: 575610
  misc_feature: HIJSMM301AMBO0.16.78.H01.1.454.light.4.raw

SEQ ID NO: 591855 - DNA, 484 bp, Homo sapiens; identical to SEQ ID NO: 535400
  misc_feature: HIJSMM301BYMC0.46.26.C04.1.454.light.4.raw

SEQ ID NO: 591856 - DNA, 488 bp, Homo sapiens
  misc_feature: HIJSMM301DNBHW.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgtcaacatatgatatttattctccagcgttcggccaggggaccaaggtggaagtcaagcgaactgtggctgcaccatctgtt

SEQ ID NO: 591857 - DNA, 502 bp, Homo sapiens; identical to SEQ ID NO: 540449
  misc_feature: HIJSMM301DLESM.10.71.G05.1.454.light.4.raw

SEQ ID NO: 591858 - DNA, 497 bp, Homo sapiens; identical to SEQ ID NO: 567078
  misc_feature: HIJSMM301DBW3E.26.26.C04.1.454.light.4.raw

SEQ ID NO: 591859 - DNA, 484 bp, Homo sapiens
  misc_feature: HIJSMM301BBSG0.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctcggtcactctgttcccaccctcctctatgagct

SEQ ID NO: 591860 - DNA, 479 bp, Homo sapiens; identical to SEQ ID NO: 535118
  misc_feature: HIJSMM301ERUM8.13.59.F04.1.454.light.4.raw

SEQ ID NO: 591861 - DNA, 485 bp, Homo sapiens; identical to SEQ ID NO: 591644
  misc_feature: HIJSMM301ERTT5.8.49.E05.1.454.light.4.raw

SEQ ID NO: 591862 - DNA, 467 bp, Homo sapiens; identical to SEQ ID NO: 566525
  misc_feature: HIJSMM301AR770.13.4.A04.1.454.light.4.raw

SEQ ID NO: 591863 - DNA, 454 bp, Homo sapiens
  misc_feature: HIJSMM301CF487.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcctcctcggtcactctgttcccgccctcctccacgagagta

SEQ ID NO: 591864 - DNA, 499 bp, Homo sapiens; identical to SEQ ID NO: 560695
  misc_feature: HIJSMM301C4ZG2.2.34.D01.1.454.light.4.raw

SEQ ID NO: 591865 - DNA, 512 bp, Homo sapiens
  misc_feature: HIJSMM301DHECM.48.57.F02.1.454.light.4.raw
agtatacatacacgaccggtgctcgatttagctcgatatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccgccct

SEQ ID NO: 591866 - DNA, 489 bp, Homo sapiens; identical to SEQ ID NO: 536013
  misc_feature: HIJSMM301CEPV0.26.23.C01.1.454.light.4.raw

SEQ ID NO: 591867 - DNA, 529 bp, Homo sapiens
  misc_feature: HIJSMM301DHXCF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccaaggtacggaagtacgtaaacgaactagtggcgtgcaccactctcgttcgtttctacttcttcccgtcccgacgtctcgt

SEQ ID NO: 591868 - DNA, 509 bp, Homo sapiens
  misc_feature: HIJSMM301BUK3C.51.42.D09.1.454.light.4.raw
cgatcgtatacacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtgggcccaggtggggatgagggtgattactactgttactcaacagacattactactactcatagggtgttcggcggagggaccaagctgaccgtcctaggtcagcccaaggctgccccctcggtcactctcgttccca

SEQ ID NO: 591869 - DNA, 483 bp, Homo sapiens
  misc_feature: HIJSMM301CBAFB.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggaggaccgagggtggagatcagacgaa

SEQ ID NO: 591870 - DNA, 497 bp, Homo sapiens
  misc_feature: HIJSMM301C5KX1.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttccg

SEQ ID NO: 591871 - DNA, 489 bp, Homo sapiens; identical to SEQ ID NO: 543809
  misc_feature: HIJSMM301B6LHA.19.71.G05.1.454.light.4.raw

SEQ ID NO: 591872 - DNA, 505 bp, Homo sapiens
  misc_feature: HIJSMM301C2A2D.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggaccactttcggccctgggaccaaagtggatatcaaacgaactgtggctgcaccatctgtctt

SEQ ID NO: 591873 - DNA, 505 bp, Homo sapiens; identical to SEQ ID NO: 535503
  misc_feature: HIJSMM301DUFSI.8.28.C06.1.454.light.4.raw

SEQ ID NO: 591874 - DNA, 504 bp, Homo sapiens; identical to SEQ ID NO: 536385
  misc_feature: HIJSMM301EC6NS.27.78.H01.1.454.light.4.raw

SEQ ID NO: 591875 - DNA, 487 bp, Homo sapiens; identical to SEQ ID NO: 539929
  misc_feature: HIJSMM301EZUDC.21.52.E08.1.454.light.4.raw

SEQ ID NO: 591876 - DNA, 494 bp, Homo sapiens
  misc_feature: HIJSMM301BP8PO.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggtagggaccagggtggagatcaaacgaactgtggctgcaccatctgtcttcta

SEQ ID NO: 591877 - DNA, 505 bp, Homo sapiens; identical to SEQ ID NO: 535987
  misc_feature: HIJSMM301BS0ND.18.37.D04.1.454.light.4.raw

SEQ ID NO: 591878 - DNA, 486 bp, Homo sapiens
  misc_feature: HIJSMM301C01LZ.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaaactgaccgtcctaggtcagcccaagggctgcccccc

SEQ ID NO: 591879 - DNA, 495 bp, Homo sapiens; identical to SEQ ID NO: 576363
  misc_feature: HIJSMM301DM6SK.27.78.H01.1.454.light.4.raw

SEQ ID NO: 591880 - DNA, 507 bp, Homo sapiens; identical to SEQ ID NO: 535641
  misc_feature: HIJSMM301E083L.10.88.H11.1.454.light.4.raw

SEQ ID NO: 591881 - DNA, 496 bp, Homo sapiens; identical to SEQ ID NO: 535109
  misc_feature: HIJSMM301D7XE2.16.78.H01.1.454.light.4.raw

SEQ ID NO: 591882 - DNA, 507 bp, Homo sapiens
  misc_feature: HIJSMM301BWOQB.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctggggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 591883 - DNA, 491 bp, Homo sapiens; identical to SEQ ID NO: 535294
  misc_feature: HIJSMM301BLAGP.16.68.G02.1.454.light.4.raw

SEQ ID NO: 591884 - DNA, 486 bp, Homo sapiens; identical to SEQ ID NO: 536329
  misc_feature: HIJSMM301CDAIO.21.4.A04.1.454.light.4.raw

SEQ ID NO: 591885 - DNA, 468 bp, Homo sapiens
  misc_feature: HIJSMM301A1607.49.37.D04.1.454.light.4.raw
agtcgagagacacgaccggtgctcgatttagtagcatactgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatccgtacacttttggccaggggaccaggctggatatcagacgaa

SEQ ID NO: 591886 - DNA, 469 bp, Homo sapiens
  misc_feature: HIJSMM301CBRFI.3.1.A01.1.454.light.4.raw
  modified_base (453)..(453): a, c, t, g, unknown or other
agacgcactccacgaccggtgctcgatttagacgtctcatcaggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaaacgttcagcggcagtggatctgggacagagttcactctcaccatcagcagcctgcagcctgacgatgtggcaacttattactgccaacagtatgatagttattggacgttggccaaggaccgaagaatagaaatanaaacgaaactagtggc

SEQ ID NO: 591887 - DNA, 496 bp, Homo sapiens
  misc_feature: HIJSMM301BN44A.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaagggaccgaaggtgggaagtcgaaacgaactagtggctgcaccatctgtctt

SEQ ID NO: 591888 - DNA, 484 bp, Homo sapiens
  misc_feature: HIJSMM301DTBTO.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgtcgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 591889 - DNA, 486 bp, Homo sapiens; identical to SEQ ID NO: 535043
  misc_feature: HIJSMM301DOMMN.46.35.D02.1.454.light.4.raw

SEQ ID NO: 591890 - DNA, 499 bp, Homo sapiens; identical to SEQ ID NO: 537739
  misc_feature: HIJSMM301ENBEB.12.86.H09.1.454.light.4.raw

SEQ ID NO: 591891 - DNA, 507 bp, Homo sapiens; identical to SEQ ID NO: 536666
  misc_feature: HIJSMM301ELVVJ.11.57.F02.1.454.light.4.raw

SEQ ID NO: 591892 - DNA, 498 bp, Homo sapiens
  misc_feature: HIJSMM301B5D7B.12.37.D04.1.454.light.4.raw
  modified_base (368)..(368): a, c, t, g, unknown or other
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaattttttaaattggtttcagcagaaaccagggaaagcccctagactcctgattcacgaggcatccaattcggaaataggggtcccacgaaggttcagtggaggtggagctgggacagattttaccctnaccatcagcagcctgcagcctgaagatcttgcaacatattactgtcaacagtataataatctcccgtacacttttggccaggggaccaagctggagatcaaacgaactgtggctgcaccatctgtcttca

SEQ ID NO: 591893 - DNA, 492 bp, Homo sapiens
  misc_feature: HIJSMM301DS920.49.60.F05.1.454.light.4.raw
agtcgagagacacgaccggtgctcgatttagtacgtcatcagggaaagggggaggaactgctcagttaggacccagagggaaccatggaagccccagctcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtttattactgtcaacagcgtaccacaggattcactttcggccctgggaccagagtggatatcaaacgaactgtggctgcaccatctgtcttc

SEQ ID NO: 591894 - DNA, 499 bp, Homo sapiens; identical to SEQ ID NO: 537739
  misc_feature: HIJSMM301C1UWL.12.86.H09.1.454.light.4.raw

SEQ ID NO: 591895 - DNA, 481 bp, Homo sapiens; identical to SEQ ID NO: 535993
  misc_feature: HIJSMM301BSKRM.21.25.C03.1.454.light.4.raw

SEQ ID NO: 591896 - DNA, 497 bp, Homo sapiens; identical to SEQ ID NO: 536371
  misc_feature: HIJSMM301DXC1X.16.78.H01.1.454.light.4.raw

SEQ ID NO: 591897 - DNA, 492 bp, Homo sapiens
  misc_feature: HIJSMM301B32S4.19.71.G05.1.454.light.4.raw
  modified_base (432)..(432): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaanaatattattatacttcgtggacgttcggccaagggaccaaggttaggataatcagacgaa

SEQ ID NO: 591898 - DNA, 493 bp, Homo sapiens; identical to SEQ ID NO: 540903
  misc_feature: HIJSMM301EKH2E.10.20.B09.1.454.light.4.raw

SEQ ID NO: 591899 - DNA, 522 bp, Homo sapiens
  misc_feature: HIJSMM301EL27G.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaggggaccaggctgaccgtcctaggtcagcccaaggctgccccctcggtcactctgttcccaccct

SEQ ID NO: 591900 - DNA, 500 bp, Homo sapiens
  misc_feature: HIJSMM301CK2BA.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggcctgccccctcggtcactctccg

SEQ ID NO: 591901 - DNA, 491 bp, Homo sapiens; identical to SEQ ID NO: 582029
  misc_feature: HIJSMM301BWKH8.16.73.G07.1.454.light.4.raw

SEQ ID NO: 591902 - DNA, 486 bp, Homo sapiens; identical to SEQ ID NO: 536261
  misc_feature: HIJSMM301EBUUY.26.55.E11.1.454.light.4.raw

SEQ ID NO: 591903 - DNA, 515 bp, Homo sapiens
  misc_feature: HIJSMM301CP57J.40.42.D09.1.454.light.4.raw
tctagcgactcacgaccggtgctcgatttagacacatacgcagggaaaggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaacccactgtcactctgttccacctcctcagtcgctaga

SEQ ID NO: 591904 - DNA, 485 bp, Homo sapiens
  misc_feature: HIJSMM301C68I9.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggcagggaccaaggtggaagtcaagcgaactgtggctgcacatctgt

SEQ ID NO: 591905 - DNA, 508 bp, Homo sapiens; identical to SEQ ID NO: 552440
  misc_feature: HIJSMM301EPDQK.5.24.C02.1.454.light.4.raw

SEQ ID NO: 591906 - DNA, 492 bp, Homo sapiens
  misc_feature: HIJSMM301DSF3F.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttaattggacgttcggccgagggaccgaaggtacgaaagtagagacgaactgtggctgcaccatctcg

SEQ ID NO: 591907 - DNA, 514 bp, Homo sapiens
  misc_feature: HIJSMM301EVD7E.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggaggggaccaagctggccgtcctaggtcagcccaaggctgccccctggtcactctgttcccaccctcctcgagtagtaca

SEQ ID NO: 591908 - DNA, 493 bp, Homo sapiens
  misc_feature: HIJSMM301AZA8Y.41.23.C01.1.454.light.4.raw
tctatactatcacgaccggtgctcgatttagtacacgtgattagggattgggggggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtcttggtcagcccaaggctcgccccctcggt

SEQ ID NO: 591909 - DNA, 486 bp, Homo sapiens; identical to SEQ ID NO: 535043
  misc_feature: HIJSMM301DU6YX.46.35.D02.1.454.light.4.raw

SEQ ID NO: 591910 - DNA, 499 bp, Homo sapiens; identical to SEQ ID NO: 560695
  misc_feature: HIJSMM301CA1XS.2.34.D01.1.454.light.4.raw

SEQ ID NO: 591911 - DNA, 475 bp, Homo sapiens
  misc_feature: HIJSMM301BG2ZD.49.28.C06.1.454.light.4.raw
agtcgagagacacgaccggtgctcgatttagagctcacgtattgggtttggggcagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccaaggtggagatcaagcgaactgtggc

SEQ ID NO: 591912 - DNA, 503 bp, Homo sapiens
  misc_feature: HIJSMM301BURGU.48.38.D05.1.454.light.4.raw
agtatacatacacgaccggtgctcgatttagtatctgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 591913 - DNA, 498 bp, Homo sapiens
  misc_feature: HIJSMM301A9T3R.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccgaaagtaggaggatcaaacgaactagtggctgcaccatctgtctt

SEQ ID NO: 591914 - DNA, 331 bp, Homo sapiens
  misc_feature: HIJSMM301EZ2RQ.9.13.B02.1.454.light.4.raw
tgatacgtctcacgaccggtgctcgatttagtctagcgacttccgcgggagccgtgacagtggcctggaaggcagatagcagccccgtcaaggcgggagtggagaccaccacaccctccaaacaaagcaacaacaagtacgcggccagcagctatctgagcctgaccatcagcagggccgaagccggggatgaggccgactatcactgtcaggtgtgggatggcagtggtgatcatcgagggtgttcggcggagggaccaagctgaccgtcctaggtcagcccaaggctgccccctcggtcactctgttcccaccctcctcagacgtatca

SEQ ID NO: 591915 - DNA, 494 bp, Homo sapiens
  misc_feature: HIJSMM301CI71H.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacgcagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 591916 - DNA, 481 bp, Homo sapiens
  misc_feature: HIJSMM301EE35W.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaagtcaaacgaactagtgg

SEQ ID NO: 591917 - DNA, 482 bp, Homo sapiens
  misc_feature: HIJSMM301D4ILM.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccaaggtggagatcaaacgaactgtggctgcaccta

SEQ ID NO: 591918 - DNA, 485 bp, Homo sapiens
  misc_feature: HIJSMM301CS7BS.41.17.B06.1.454.light.4.raw
  modified_base (353)..(353): a, c, t, g, unknown or other
tctatactatcacgaccggtgctcgatttagtcgatagtgaaggggggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttacnctcaccatcaacggcctgcagtctgaagattctgcagtttattactgtcagcagtatgttgactggcctccgctcactttcggcggagggaccaaggtggagatcaaacgaactgtggctgcaccatctgtt

SEQ ID NO: 591919 - DNA, 517 bp, Homo sapiens
  misc_feature: HIJSMM301CS0I9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtgacacttgggtgttcggcggagggaccaggctgaccgtcctaggtcagcccaaggctgccccctcggtcactctgttccc

SEQ ID NO: 591920 - DNA, 472 bp, Homo sapiens
  misc_feature: HIJSMM301CE08M.51.52.E08.1.454.light.4.raw
cgatcgtatacacgaccggtgctcgatttagtcgagctctcagagagaaagggggctgtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactagggaaaaaatatgctcgttggttccagcagaaggcgggccaggcccctgtcttgatgatttataaagacactgagcggccctcagggatccctgagcgattctccggctccagctcagggactacagtcaccttgaccatcaggcggggcccaggttgacgatgaggctgactattactgttactctgcggctgacaacaattctgggatattcggcggaggaccaagctgaccgtcttagg

SEQ ID NO: 591921 - DNA, 507 bp, Homo sapiens
  misc_feature: HIJSMM301AGQKR.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgttcccg

SEQ ID NO: 591922 - DNA, 494 bp, Homo sapiens; identical to SEQ ID NO: 534992
  misc_feature: HIJSMM301C4A86.9.1.A01.1.454.light.4.raw

SEQ ID NO: 591923 - DNA, 498 bp, Homo sapiens; identical to SEQ ID NO: 559536
  misc_feature: HIJSMM301DADIK.40.57.F02.1.454.light.4.raw

SEQ ID NO: 591924 - DNA, 484 bp, Homo sapiens
  misc_feature: HIJSMM301C7IRE.43.87.H10.1.454.light.4.raw
tgtgagtagtcacgaccggtgctcgatttagcagtactgcgttgggtttgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggtcagcccaaggctgccccctcggtcactctgtt

SEQ ID NO: 591925 - DNA, 444 bp, Homo sapiens; identical to SEQ ID NO: 540477
  misc_feature: HIJSMM301D6V8S.17.21.B10.1.454.light.4.raw

SEQ ID NO: 591926 - DNA, 502 bp, Homo sapiens
  misc_feature: HIJSMM301B8Z1R.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctctcccatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaaggacacgactggagattaaacg

SEQ ID NO: 591927 - DNA, 491 bp, Homo sapiens
  misc_feature: HIJSMM301EXRLO.16.53.E09.1.454.light.4.raw
tgtactactccacgaccggtgctcgatttagagagagtgtgttgggtttaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgt

SEQ ID NO: 591928 - DNA, 491 bp, Homo sapiens
  misc_feature: HIJSMM301BWM56.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttcccgccat

SEQ ID NO: 591929 - DNA, 487 bp, Homo sapiens
  misc_feature: HIJSMM301DISCQ.46.79.H02.1.454.light.4.raw
actagcagtacacgaccggtgctcgatttagtgtcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacc

SEQ ID NO: 591930 - DNA, 496 bp, Homo sapiens; identical to SEQ ID NO: 535541
  misc_feature: HIJSMM301DTJAA.3.33.C11.1.454.light.4.raw

SEQ ID NO: 591931 - DNA, 490 bp, Homo sapiens; identical to SEQ ID NO: 536746
  misc_feature: HIJSMM301BTLRY.17.21.B10.1.454.light.4.raw

SEQ ID NO: 591932 - DNA, 521 bp, Homo sapiens
  misc_feature: HIJSMM301ALWNI.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgccgacggaccgaacggtaggaaagtactaagacgaacgtacgtaggtcgtgtcaccgaactctgtcgttctactcttcccgt

SEQ ID NO: 591933 - DNA, 494 bp, Homo sapiens; identical to SEQ ID NO: 545825
  misc_feature: HIJSMM301D9YSR.48.48.E04.1.454.light.4.raw

SEQ ID NO: 591934 - DNA, 454 bp, Homo sapiens; identical to SEQ ID NO: 534964
  misc_feature: HIJSMM301BMH0V.19.86.H09.1.454.light.4.raw

SEQ ID NO: 591935 - DNA, 498 bp, Homo sapiens
  misc_feature: HIJSMM301EFNKV.15.31.C09.1.454.light.4.raw
tctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcgggcggagggaccaagctgaccgtcctaggtcaggcccaagg

SEQ ID NO: 591936 - DNA, 494 bp, Homo sapiens; identical to SEQ ID NO: 534994
  misc_feature: HIJSMM301BO9T3.27.78.H01.1.454.light.4.raw

SEQ ID NO: 591937 - DNA, 505 bp, Homo sapiens
  misc_feature: HIJSMM301CJIO0.49.70.G04.1.454.light.4.raw
agtcgagagacacgaccggtgctcgatttagtgtagtgtgaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcaggggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtccactcttccg

SEQ ID NO: 591938 - DNA, 498 bp, Homo sapiens
  misc_feature: HIJSMM301CVXWC.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaaacctgtggctgcaccatctgtcttcatt

SEQ ID NO: 591939 - DNA, 503 bp, Homo sapiens
  misc_feature: HIJSMM301BOAEN.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttaccctggacgttcggccaagggaccagggtggaaatacaaacgaactgtggctgcaccatctgtcttctatcttccccg

SEQ ID NO: 591940 - DNA, 495 bp, Homo sapiens; identical to SEQ ID NO: 535143
  misc_feature: HIJSMM301B82AI.51.29.C07.1.454.light.4.raw

SEQ ID NO: 591941 - DNA, 493 bp, Homo sapiens; identical to SEQ ID NO: 536246
  misc_feature: HIJSMM301C15OS.49.66.F11.1.454.light.4.raw

SEQ ID NO: 591942 - DNA, 513 bp, Homo sapiens
  misc_feature: HIJSMM301CQOX2.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccggaagactgaccgtcctacggttcgagcccaacggacgtgcccccgtccggtccgta

SEQ ID NO: 591943 - DNA, 498 bp, Homo sapiens
  misc_feature: HIJSMM301DPNR7.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactcgtggctgcaccatctgtt

SEQ ID NO: 591944 - DNA, 489 bp, Homo sapiens; identical to SEQ ID NO: 536663
  misc_feature: HIJSMM301CCT13.16.72.G06.1.454.light.4.raw

SEQ ID NO: 591945 - DNA, 483 bp, Homo sapiens
  misc_feature: HIJSMM301DCN90.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtggaggtggttttcggcggagggaccaagctgaccgtcctaagtcacgcccaaggcc

SEQ ID NO: 591946 - DNA, 499 bp, Homo sapiens
  misc_feature: HIJSMM301CD6KW.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgcggtttattactgtcagcagtataataactggcctccacggtacacttttggccgaggggaccaagctggagatcaaacgaactgtggctgcaccatctgtt

SEQ ID NO: 591947 - DNA, 514 bp, Homo sapiens
  misc_feature: HIJSMM301BR017.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggacgaacggtaggaagtacaaacgaactagtggcgtgcgaccactctcgtcttctatccttcccgtcccact

SEQ ID NO: 591948 - DNA, 475 bp, Homo sapiens
  misc_feature: HIJSMM301BWSVO.51.34.D01.1.454.light.4.raw
cgatcgtatacacgaccggtgctcgatttagatcgtctgtgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggctgca

SEQ ID NO: 591949 - DNA, 486 bp, Homo sapiens; identical to SEQ ID NO: 535523
  misc_feature: HIJSMM301CZLSE.22.73.G07.1.454.light.4.raw

SEQ ID NO: 591950 - DNA, 514 bp, Homo sapiens
  misc_feature: HIJSMM301DHGAK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcggtccacggaccgaaggtaggaagtacgaaacgaactagtaggcgtgcaccactctgtcttctactcttcccgtccact

SEQ ID NO: 591951 - DNA, 506 bp, Homo sapiens
  misc_feature: HIJSMM301A8OL3.4.28.C06.1.454.light.4.raw
  modified_base (234)..(234): a, c, t, g, unknown or other
agcactgtagcacgaccggtgctcgatttagagctcacgtattgggtttggggctgggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactcccctattctagtcatgtatcaaactacgaagcgcccctcaggggtccctgagcgctttctggctccaagtctggggacacagccactctgactctctccggggcccaggccatcgatgagggagactattactgtcaggcgtgggacagcacaaactgcagtcttcggcggaggggaccagggtgaccgtcctgggtcagccaaggctgccccctcggtcactctgttccacct

SEQ ID NO: 591952 - DNA, 503 bp, Homo sapiens
  misc_feature: HIJSMM301BX8Q1.51.33.C11.1.454.light.4.raw
cgatcgtatacacgaccggtgctcgatttagagtgagctcgttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgtacttttactgtcaggcgtgggacagcgacactcgccgtggttcgggcgggggaccgaagctcgtaccgtccgtccggtcacgcccgaaggctccgccccctcggt

SEQ ID NO: 591953 - DNA, 484 bp, Homo sapiens; identical to SEQ ID NO: 535400
  misc_feature: HIJSMM301A4BU4.46.26.C04.1.454.light.4.raw

SEQ ID NO: 591954 - DNA, 503 bp, Homo sapiens
  misc_feature: HIJSMM301AG2Q8.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactc

SEQ ID NO: 591955 - DNA, 496 bp, Homo sapiens; identical to SEQ ID NO: 535109
  misc_feature: HIJSMM301EJ7VQ.16.78.H01.1.454.light.4.raw

SEQ ID NO: 591956 - DNA, 505 bp, Homo sapiens
  misc_feature: HIJSMM301DCYRM.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccaaggtggagttcaaacgaactgtggctgcaccatctgtcttcatcttcccgccta

SEQ ID NO: 591957 - DNA, 490 bp, Homo sapiens
  misc_feature: HIJSMM301DMVE3.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcgagggaccaaggtggagatcaaacgaa

SEQ ID NO: 591958 - DNA, 497 bp, Homo sapiens; identical to SEQ ID NO: 568860
  misc_feature: HIJSMM301CGFXN.18.59.F04.1.454.light.4.raw

SEQ ID NO: 591959 - DNA, 496 bp, Homo sapiens
  misc_feature: HIJSMM301EIGG6.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggccaagctgaccgtcctgcgtcagcccaaggctgccccctcggtcactctcgttcccta

SEQ ID NO: 591960 - DNA, 491 bp, Homo sapiens
  misc_feature: HIJSMM301DC7E6.48.73.G07.1.454.light.4.raw
agtatacatacacgaccggtgctcgatttagctctacgctcagggcacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccaggtcccctgtgttggtcatccgtgaagataacaagcggcctcaggcatccctgagcgattctctggctccaactctgggaacactgccaccctgaccatcaggggacccaggccttggatgaggctgactatcactgtcaggcgtgggacagcaacactgcgatttcggcgggggtaccaggctgaccgtc

SEQ ID NO: 591961 - DNA, 486 bp, Homo sapiens; identical to SEQ ID NO: 535043
  misc_feature: HIJSMM301EG3N0.46.35.D02.1.454.light.4.raw

SEQ ID NO: 591962 - DNA, 447 bp, Homo sapiens; identical to SEQ ID NO: 535020
  misc_feature: HIJSMM301AYMY1.18.9.A09.1.454.light.4.raw

SEQ ID NO: 591963 - DNA, 519 bp, Homo sapiens
  misc_feature: HIJSMM301AS657.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtccactctgttccccaccctcctcc

SEQ ID NO: 591964 - DNA, 525 bp, Homo sapiens
  misc_feature: HIJSMM301DBLNV.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtcaacggacgaacggtaggaaggtacgaaacgaacgtagtggcgtgcgaccactcctgtcttctactcttcccgtccctactctcgt

SEQ ID NO: 591965 - DNA, 509 bp, Homo sapiens
  misc_feature: HIJSMM301B0PBA.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacgggaccgaaggtaggaatacaaacgaacctagtggctgcaccatctgtcttctatcttccccg

SEQ ID NO: 591966 - DNA, 482 bp, Homo sapiens
  misc_feature: HIJSMM301DHDP0.3.38.D05.1.454.light.4.raw
  modified_base (476)..(476): a, c, t, g, unknown or other
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactaactgtcaacagagtttcactaccctctcacttcgtcggggacggaacggtaggagagtacaacgaacagtgntgcaca

SEQ ID NO: 591967 - DNA, 495 bp, Homo sapiens; identical to SEQ ID NO: 535821
  misc_feature: HIJSMM301B7V5Q.3.31.C09.1.454.light.4.raw

SEQ ID NO: 591968 - DNA, 494 bp, Homo sapiens; identical to SEQ ID NO: 534994
  misc_feature: HIJSMM301DHQVH.27.78.H01.1.454.light.4.raw

SEQ ID NO: 591969 - DNA, 508 bp, Homo sapiens
  misc_feature: HIJSMM301EADHX.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgctagtttattactgtcagcagcgtgccactttcggcggaggtgccactttcggcgggagggaccaaataagaggtcgaaacgaactgtggctgcaccatctgtcttcattcc

SEQ ID NO: 591970 - DNA, 488 bp, Homo sapiens; identical to SEQ ID NO: 535568
  misc_feature: HIJSMM301C2JDT.21.4.A04.1.454.light.4.raw

SEQ ID NO: 591971 - DNA, 483 bp, Homo sapiens; identical to SEQ ID NO: 535317
  misc_feature: HIJSMM301CIS40.4.1.A01.1.454.light.4.raw

SEQ ID NO: 591972 - DNA, 524 bp, Homo sapiens
  misc_feature: HIJSMM301COENW.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccgggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacctcctc

SEQ ID NO: 591973 - DNA, 520 bp, Homo sapiens; identical to SEQ ID NO: 556231
  misc_feature: HIJSMM301CU1VM.41.19.B08.1.454.light.4.raw

SEQ ID NO: 591974 - DNA, 519 bp, Homo sapiens
  misc_feature: HIJSMM301BI2KN.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaacggtacggaagtacaagacgaactacgtggcgtgcgaccactctgtctttattcttcccgtcccta

SEQ ID NO: 591975 - DNA, 494 bp, Homo sapiens
  misc_feature: HIJSMM301ENY9J.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcagcagcctgcagtctgaagattgtgcaatttattactgtcagcaatataatacctggcctccgctcactttcggcggagggaccaaggttgagatcaaacgaactgtggctgcacc

SEQ ID NO: 591976 - DNA, 488 bp, Homo sapiens; identical to SEQ ID NO: 536056
  misc_feature: HIJSMM301A61J5.47.36.D03.1.454.light.4.raw

SEQ ID NO: 591977 - DNA, 499 bp, Homo sapiens
  misc_feature: HIJSMM301DA67V.52.34.D01.1.454.light.4.raw
cgcagtacgacacgaccggtgctcgatttagatcgtctgtgttgggtttggggtgggtccaggaggcagaactctgggtgtctcgccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaacttgcgaccaaggtcaccgtcctggtcagcccaaaggcccaaacccactgtcacttc

SEQ ID NO: 591978 - DNA, 507 bp, Homo sapiens; identical to SEQ ID NO: 539817
  misc_feature: HIJSMM301AWFAJ.5.24.C02.1.454.light.4.raw

SEQ ID NO: 591979 - DNA, 488 bp, Homo sapiens; identical to SEQ ID NO: 556257
  misc_feature: HIJSMM301ADC2J.52.3.A03.1.454.light.4.raw

SEQ ID NO: 591980 - DNA, 484 bp, Homo sapiens; identical to SEQ ID NO: 537878
  misc_feature: HIJSMM301BIWG0.17.34.D01.1.454.light.4.raw

SEQ ID NO: 591981 - DNA, 416 bp, Homo sapiens; identical to SEQ ID NO: 536892
  misc_feature: HIJSMM301EG8ZQ.16.46.E02.1.454.light.4.raw

SEQ ID NO: 591982 - DNA, 484 bp, Homo sapiens
  misc_feature: HIJSMM301EN2OP.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaacagacttacaatataccgaggacgttcggtcaagggaccaaggtggagatcaaacgaactgtggctgcaccatctgt

SEQ ID NO: 591983 - DNA, 485 bp, Homo sapiens; identical to SEQ ID NO: 535880
  misc_feature: HIJSMM301CGQU6.7.75.G09.1.454.light.4.raw

SEQ ID NO: 591984 - DNA, 489 bp, Homo sapiens; identical to SEQ ID NO: 535139
  misc_feature: HIJSMM301CAQ1F.14.55.E11.1.454.light.4.raw

SEQ ID NO: 591985 - DNA, 505 bp, Homo sapiens
  misc_feature: HIJSMM301CTI9V.48.37.D04.1.454.light.4.raw
agtatacatacacgaccggtgctcgatttagtagcatactgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaagggtggacatcaaacgaactgtggctgcaccatctgtcttcatcttccccg

SEQ ID NO: 591986 - DNA, 500 bp, Homo sapiens; identical to SEQ ID NO: 546613
  misc_feature: HIJSMM301EKYTJ.11.21.B10.1.454.light.4.raw

SEQ ID NO: 591987 - DNA, 506 bp, Homo sapiens; identical to SEQ ID NO: 563474
  misc_feature: HIJSMM301CFKB8.10.27.C05.1.454.light.4.raw

SEQ ID NO: 591988 - DNA, 466 bp, Homo sapiens; identical to SEQ ID NO: 535366
  misc_feature: HIJSMM301D9XN9.13.4.A04.1.454.light.4.raw

SEQ ID NO: 591989 - DNA, 508 bp, Homo sapiens
  misc_feature: HIJSMM301AOJIX.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcgaagatgaggctgactattattgtaagtccggggacagaagtggtaattacatggtgttcggcggagggaccaagctgaccgtcctacgtcagcccaaggctgccccctcggtcactctcg

SEQ ID NO: 591990 - DNA, 503 bp, Homo sapiens
  misc_feature: HIJSMM301ENHNJ.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactagtggctgcaccatctgtcttcatcttcccgccta

SEQ ID NO: 591991 - DNA, 486 bp, Homo sapiens; identical to SEQ ID NO: 536261
  misc_feature: HIJSMM301A1I2G.26.55.E11.1.454.light.4.raw

SEQ ID NO: 591992 - DNA, 502 bp, Homo sapiens; identical to SEQ ID NO: 541971
  misc_feature: HIJSMM301AE8KZ.4.39.D06.1.454.light.4.raw

SEQ ID NO: 591993 - DNA, 494 bp, Homo sapiens; identical to SEQ ID NO: 540110
  misc_feature: HIJSMM301BFT8U.51.71.G05.1.454.light.4.raw

SEQ ID NO: 591994 - DNA, 493 bp, Homo sapiens
  misc_feature: HIJSMM301AW375.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggttggagggaccaaggtggaggtcaaacgaactagtggctgcaccatctgtcttcatt

SEQ ID NO: 591995 - DNA, 493 bp, Homo sapiens
  misc_feature: HIJSMM301CS7V1.22.14.B03.1.454.light.4.raw
acatacgcgtcacgaccggtgctcgatttagtgtgagtagttccgcgggggagctacaacaggcaggcaggggcagcaagatggtgttgcacgaccccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacaggatttcactctcaccatcagcagcctgcaggctgaagatgtggcagtttatattgtcagcaatattatattcctcctcagacgttcggcaagggaccaaggtggaaatcaaacgactgtggctgca

SEQ ID NO: 591996 - DNA, 494 bp, Homo sapiens; identical to SEQ ID NO: 557656
  misc_feature: HIJSMM301BER5D.22.5.A05.1.454.light.4.raw

SEQ ID NO: 591997 - DNA, 517 bp, Homo sapiens; identical to SEQ ID NO: 574078
  misc_feature: HIJSMM301DV3Z9.10.28.C06.1.454.light.4.raw

SEQ ID NO: 591998 - DNA, 449 bp, Homo sapiens
  misc_feature: HIJSMM301CS4LS.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccaccctcctccatacctcgta

SEQ ID NO: 591999 - DNA, 498 bp, Homo sapiens
  misc_feature: HIJSMM301COPS6.26.29.C07.1.454.light.4.raw
agactatactcacgaccggtgctcgatttagagtgctacgaagggaaagggactgactaccacctgcaggtcagggccaaggttatgggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgccact

SEQ ID NO: 592000 - DNA, 499 bp, Homo sapiens
  misc_feature: HIJSMM301E2Q88.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataaagagttacttagcttggttccagcagaaaccaggacatcgtcctgcactgctcatttactgggcgtctacccgggaatccggggtccctgaccgattcagtggcagcgggtctgggacagatttcactctcacccatcagcagcctgcaggctgaagatgtggcagtttattattgtcagcaatattatattcctcctcagacgttggccaaggaccaaggtggaaatcaaacgaaactgtggctgcaccca

SEQ ID NO: 592001 - DNA, 495 bp, Homo sapiens
  misc_feature: HIJSMM301BTYJ6.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccagggaccaagctggagatcaaacgaactgtggctgcaccatctgtt

SEQ ID NO: 592002 - DNA, 488 bp, Homo sapiens
  misc_feature: HIJSMM301ETVBN.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccagggcagaggacgaggctgactattattgtcaatcagcagacaacagtaatacttatctttatgtcttcggatctgggaccagggtcaccgtcctaggtcaggcccaaggccaacccc

SEQ ID NO: 592003 - DNA, 491 bp, Homo sapiens; identical to SEQ ID NO: 536211
  misc_feature: HIJSMM301BD2ZL.16.53.E09.1.454.light.4.raw

SEQ ID NO: 592004 - DNA, 486 bp, Homo sapiens; identical to SEQ ID NO: 535043
  misc_feature: HIJSMM301CFEST.46.35.D02.1.454.light.4.raw

SEQ ID NO: 592005 - DNA, 487 bp, Homo sapiens; identical to SEQ ID NO: 537573
  misc_feature: HIJSMM301C3XDF.3.10.A10.1.454.light.4.raw

SEQ ID NO: 592006 - DNA, 497 bp, Homo sapiens
  misc_feature: HIJSMM301CYLMF.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctg

SEQ ID NO: 592007 - DNA, 467 bp, Homo sapiens
  misc_feature: HIJSMM301DRN9P.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacagggtcccatcaaggttcagtggaagtggctctgggacagattttactttcaccatcagcaggctgcagcctgaagatattgcaacatattactgtcaacagtatgatagtctcccgctcactttcggcggggggaccaaggtggagatcaagcgaa

SEQ ID NO: 592008 - DNA, 507 bp, Homo sapiens
  misc_feature: HIJSMM301DPJW5.8.42.D09.1.454.light.4.raw
ctcgcgtgtccacgaccggtgctcgatttagacacatacgcagggaaagggggggtctcaggaggcagcactctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccgcctcc

SEQ ID NO: 592009 - DNA, 511 bp, Homo sapiens
  misc_feature: HIJSMM301DZZKY.21.22.B11.1.454.light.4.raw
  modified_base (463)..(463): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggtttggggngtttcggcggagggaccaaaactgacccgtcctaagggtcagccccaa

SEQ ID NO: 592010 - DNA, 509 bp, Homo sapiens
  misc_feature: HIJSMM301B3JK3.43.5.A05.1.454.light.4.raw
tgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttggggcaaagctgccctgaccctttcgggtgcgcagcctgaggatgaggctgactattactgcttgctcgcctatgatgctgctcgggttttcggcggagggaccaagttgaccgtctaggtcagcccaaggctgccccctggtcactctgttcccaccctcctca

SEQ ID NO: 592011 - DNA, 495 bp, Homo sapiens; identical to SEQ ID NO: 569639
  misc_feature: HIJSMM301COVJB.10.20.B09.1.454.light.4.raw

SEQ ID NO: 592012 - DNA, 503 bp, Homo sapiens
  misc_feature: HIJSMM301BLWDM.43.28.C06.1.454.light.4.raw
tgtgagtagtcacgaccggtgctcgatttagagctcacgtattgggtttggggggggtcacaagaggcagcgctctcgggacgtctccaccatggcctgggctctgctgctcctcactctcctcgctcaggacacagggtcctgggcccagtctgtcctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccctac

SEQ ID NO: 592013 - DNA, 492 bp, Homo sapiens
  misc_feature: HIJSMM301C306Y.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttattctgccaacaatacaccactttgtggacgttcggccgggggaccgaacggtggagatcaagcgaactgtggctgcaccatctgtcttcatcttcccg

SEQ ID NO: 592014 - DNA, 498 bp, Homo sapiens
  misc_feature: HIJSMM301BZ04F.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactacatgcaaggtacacactggcccgtcaccttcggccaagggacacgactggagattaaacgaactgtggctgcaccat

SEQ ID NO: 592015 - DNA, 484 bp, Homo sapiens
  misc_feature: HIJSMM301BXIB2.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccaccctcctcgctacgtaga

SEQ ID NO: 592016 - DNA, 501 bp, Homo sapiens; identical to SEQ ID NO: 555551
  misc_feature: HIJSMM301DU5B8.21.81.H04.1.454.light.4.raw

SEQ ID NO: 592017 - DNA, 514 bp, Homo sapiens
  misc_feature: HIJSMM301CK23N.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctggacccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctcggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcacttccg

SEQ ID NO: 592018 - DNA, 493 bp, Homo sapiens; identical to SEQ ID NO: 548028
  misc_feature: HIJSMM301DYL5C.19.83.H06.1.454.light.4.raw

SEQ ID NO: 592019 - DNA, 514 bp, Homo sapiens; identical to SEQ ID NO: 559713
  misc_feature: HIJSMM301DJDZO.8.23.C01.1.454.light.4.raw

SEQ ID NO: 592020 - DNA, 496 bp, Homo sapiens
  misc_feature: HIJSMM301A263L.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgttcgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgagtgcgtct

SEQ ID NO: 592021 - DNA, 512 bp, Homo sapiens
  misc_feature: HIJSMM301C7WJ5.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgagggccgactattactgtcaggtgtggaatggtgattatgattatgtcttcggaactgggaccaaggtcaccgtcctaggtcagcccaaggccaaccccactgtcactctgttcccgccctcctccgtgtctgat

SEQ ID NO: 592022 - DNA, 485 bp, Homo sapiens; identical to SEQ ID NO: 535688
  misc_feature: HIJSMM301CRY0X.19.5.A05.1.454.light.4.raw

SEQ ID NO: 592023 - DNA, 496 bp, Homo sapiens; identical to SEQ ID NO: 535109
  misc_feature: HIJSMM301B8ZHI.16.78.H01.1.454.light.4.raw

SEQ ID NO: 592024 - DNA, 497 bp, Homo sapiens
  misc_feature: HIJSMM301DQVND.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgacgtgcgtct

SEQ ID NO: 592025 - DNA, 484 bp, Homo sapiens; identical to SEQ ID NO: 537878
  misc_feature: HIJSMM301DMZHS.17.34.D01.1.454.light.4.raw

SEQ ID NO: 592026 - DNA, 499 bp, Homo sapiens; identical to SEQ ID NO: 560695
  misc_feature: HIJSMM301BLGCZ.2.34.D01.1.454.light.4.raw

SEQ ID NO: 592027 - DNA, 501 bp, Homo sapiens
  misc_feature: HIJSMM301AVQW0.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaacgaaactgtggctgcaccatctgtcttcatcttcccg

SEQ ID NO: 592028 - DNA, 495 bp, Homo sapiens
  misc_feature: HIJSMM301D5ETU.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcggaactgggaccaaggtcaccgtctaggtcagcccaagg

SEQ ID NO: 592029 - DNA, 499 bp, Homo sapiens
  misc_feature: HIJSMM301CJE4Z.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaa

SEQ ID NO: 592030 - DNA, 504 bp, Homo sapiens
  misc_feature: HIJSMM301BFQ4K.48.25.C03.1.454.light.4.raw
agtatacatacacgaccggtgctcgatttagtagtgtagatttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgtggtttattactgtcagcagcgtgccaactggcctctcacgttcggcggagggaccaaggtggacatcaaacgaactgtggctgcaccatctgtcttcatccttcccg

SEQ ID NO: 592031 - DNA, 481 bp, Homo sapiens
  misc_feature: HIJSMM301B2RRJ.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaatcaaagaactgtggctgcaccatctgtctt

SEQ ID NO: 592032 - DNA, 505 bp, Homo sapiens
  misc_feature: HIJSMM301DAB5Y.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggccaagctgaccgtcctaggtcagcccaaggctgccccctcggtcactcttcg

SEQ ID NO: 592033 - DNA, 512 bp, Homo sapiens
  misc_feature: HIJSMM301DN9MO.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgcccctcggtcactctgtt

SEQ ID NO: 592034 - DNA, 509 bp, Homo sapiens
  misc_feature: HIJSMM301C2YZY.47.83.H06.1.454.light.4.raw
agctcacgtacacgaccggtgctcgatttagatcacgtgcgtcgcggggggggtctcaggaggcagcgctctcaggacatctccaccattggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 592035 - DNA, 494 bp, Homo sapiens; identical to SEQ ID NO: 535276
  misc_feature: HIJSMM301AQVP7.16.6.A06.1.454.light.4.raw

SEQ ID NO: 592036 - DNA, 484 bp, Homo sapiens; identical to SEQ ID NO: 535498
  misc_feature: HIJSMM301EHW7N.47.62.F07.1.454.light.4.raw

SEQ ID NO: 592037 - DNA, 505 bp, Homo sapiens; identical to SEQ ID NO: 551320
  misc_feature: HIJSMM301BXTCJ.17.87.H10.1.454.light.4.raw

SEQ ID NO: 592038 - DNA, 483 bp, Homo sapiens; identical to SEQ ID NO: 537371
  misc_feature: HIJSMM301DMWLN.13.55.E11.1.454.light.4.raw

SEQ ID NO: 592039 - DNA, 486 bp, Homo sapiens; identical to SEQ ID NO: 543923
  misc_feature: HIJSMM301DWSFU.3.88.H11.1.454.light.4.raw

SEQ ID NO: 592040 - DNA, 468 bp, Homo sapiens
  misc_feature: HIJSMM301A48BQ.51.16.B05.1.454.light.4.raw
cgatcgtatacacgaccggtgctcgatttagagctcacgtaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctcttgccaggcgagtcaggacattataagatatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaggatcttgcaacatattactgtcaacagtatgataatgtcccgtacacttttggccaggggaccaagctggagatcagacgaactgtgg

SEQ ID NO: 592041 - DNA, 492 bp, Homo sapiens
  misc_feature: HIJSMM301DJFP2.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatcctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggttgttcctccatgcaaggtacacactggccttttggccaggggaccaacctggagatcaaatgaactgtggctgcaccatctgtctt

SEQ ID NO: 592042 - DNA, 520 bp, Homo sapiens
  misc_feature: HIJSMM301CFXGO.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggcctcccacggcccctcatctatggtgcatccaacagggccactggcatcccagccaggttcaggtggcaggtgggtctgggacagacttcactctcaccatcatcagcctggagcctgaagatgttgctagtttattactgtcaacatcgtaccgagtggccgtccgggggcctacgtttccggcccgtcgggaccgaaacgtaggagtatacaacgaacgtgtggctgcacatctgtctt

SEQ ID NO: 592043 - DNA, 444 bp, Homo sapiens; identical to SEQ ID NO: 535594
  misc_feature: HIJSMM301EAXEO.9.9.A09.1.454.light.4.raw

SEQ ID NO: 592044 - DNA, 496 bp, Homo sapiens; identical to SEQ ID NO: 540132
  misc_feature: HIJSMM301DVLWR.3.71.G05.1.454.light.4.raw

SEQ ID NO: 592045 - DNA, 510 bp, Homo sapiens
  misc_feature: HIJSMM301D5I2D.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaaatagagacgaactagtggcgtgcgaccactctgtcttctactcttcccgt

SEQ ID NO: 592046 - DNA, 498 bp, Homo sapiens
  misc_feature: HIJSMM301DQN2F.53.4.A04.1.454.light.4.raw
cgcgtatacacacgaccggtgctcgatttagagtagtgatcagggggggcacaagaggcagcactcaggacaatctccagcatggcctggtctcctctcctcctcactctcctcgctcactgcacagggtcctgggcccagtctgttctgacgcagccgccctcagtgtctggggccccagggcagagggttatcatctcctgcactgggaccagctccaacatcggggtcaggttatgatgtacactggtaccagcagcttccaggaacagcccccaaactcctcgtctatggtgacggcagtcggccctcaggggtccctggccgattctctggctccaagtctggcacctcagcctccctggccatcactgggctccaggctgaggatgagggtcattattactgccagtcctatgacaacagaatggatccttcttgggtgttcggcggagggaccaagctgaccgtcctacgtcagcccaaggctgccccctc

SEQ ID NO: 592047 - DNA, 501 bp, Homo sapiens
  misc_feature: HIJSMM301BO0L1.5.14.B03.1.454.light.4.raw
atcagacacgcacgaccggtgctcgatttagtgtgagtagttcccgggcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggacc

SEQ ID NO: 592048 - DNA, 491 bp, Homo sapiens; identical to SEQ ID NO: 535294
  misc_feature: HIJSMM301EGYES.16.68.G02.1.454.light.4.raw

SEQ ID NO: 592049 - DNA, 496 bp, Homo sapiens; identical to SEQ ID NO: 537925
  misc_feature: HIJSMM301ALWJY.22.14.B03.1.454.light.4.raw

SEQ ID NO: 592050 - DNA, 490 bp, Homo sapiens
  misc_feature: HIJSMM301EEIUT.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 592051 - DNA, 473 bp, Homo sapiens
  misc_feature: HIJSMM301D4BAU.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagccccgcagtctgaagattttgcagtttattactgtcagcaatataacaagtggccattcactttcggcccagggaccaaagtggatatcaaacgaactgtggctgcaccatctgtcttcatcttcccgccat

SEQ ID NO: 592052 - DNA, 503 bp, Homo sapiens
  misc_feature: HIJSMM301CKB8N.40.42.D09.1.454.light.4.raw
tctagcgactcacgaccggtgctcgatttagacacatacgcagggaaagggggtgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcgggcggagggaccgaagctgaccgtcctaggtcagcccaaggctgccccctcggtcact

SEQ ID NO: 592053 - DNA, 512 bp, Homo sapiens; identical to SEQ ID NO: 557832
  misc_feature: HIJSMM301CHUWZ.7.34.D01.1.454.light.4.raw

SEQ ID NO: 592054 - DNA, 475 bp, Homo sapiens
  misc_feature: HIJSMM301B2TP6.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcaggcgggacccaggctatggatgaggctgactattactgtcaggcgtgggacagcagcactcgcccgctatgtcttcggaactcggaccaaggtcaccgtctagtcaccg

SEQ ID NO: 592055 - DNA, 514 bp, Homo sapiens
  misc_feature: HIJSMM301A8RNR.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagtattttgctaacttactactgtcaacagagtttcagtcgtcccccggacgtcgtcgacggaccgacgacgtagaatagagacgaacgtagtggtctcggcaccactctcttcttctatcttcccgt

SEQ ID NO: 592056 - DNA, 487 bp, Homo sapiens; identical to SEQ ID NO: 536272
  misc_feature: HIJSMM301CTPLQ.17.25.C03.1.454.light.4.raw

SEQ ID NO: 592057 - DNA, 377 bp, Homo sapiens; identical to SEQ ID NO: 536071
  misc_feature: HIJSMM301BVS7N.40.9.A09.1.454.light.4.raw

SEQ ID NO: 592058 - DNA, 486 bp, Homo sapiens; identical to SEQ ID NO: 535385
  misc_feature: HIJSMM301B2F04.19.71.G05.1.454.light.4.raw

SEQ ID NO: 592059 - DNA, 508 bp, Homo sapiens; identical to SEQ ID NO: 545298
  misc_feature: HIJSMM301CU962.8.42.D09.1.454.light.4.raw

SEQ ID NO: 592060 - DNA, 521 bp, Homo sapiens; identical to SEQ ID NO: 538715
  misc_feature: HIJSMM301D17WD.27.23.C01.1.454.light.4.raw

SEQ ID NO: 592061 - DNA, 484 bp, Homo sapiens; identical to SEQ ID NO: 535400
  misc_feature: HIJSMM301DF9Z5.46.26.C04.1.454.light.4.raw

SEQ ID NO: 592062 - DNA, 493 bp, Homo sapiens; identical to SEQ ID NO: 536289
  misc_feature: HIJSMM301A40WR.14.5.A05.1.454.light.4.raw

SEQ ID NO: 592063 - DNA, 493 bp, Homo sapiens; identical to SEQ ID NO: 543901
  misc_feature: HIJSMM301C8FKD.48.35.D02.1.454.light.4.raw

SEQ ID NO: 592064 - DNA, 521 bp, Homo sapiens
  misc_feature: HIJSMM301EDF0D.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccgacgactgaccgtcctaggtcagcccaaggctgccccctcggtcactctgttccccg

SEQ ID NO: 592065 - DNA, 490 bp, Homo sapiens
  misc_feature: HIJSMM301AUQER.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctctacgttcgggacggggaccgaaggtaggagtatacaaacgaactgtggctgccacta

SEQ ID NO: 592066 - DNA, 497 bp, Homo sapiens
  misc_feature: HIJSMM301CQBWE.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggaccgttggtccaagggaccaaggtggatatcagacgaacgtgtggctgca

SEQ ID NO: 592067 - DNA, 503 bp, Homo sapiens
  misc_feature: HIJSMM301ETF7J.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagccaaggctgccccctcggtcta

SEQ ID NO: 592068 - DNA, 447 bp, Homo sapiens; identical to SEQ ID NO: 535201
  misc_feature: HIJSMM301B96SH.18.9.A09.1.454.light.4.raw

SEQ ID NO: 592069 - DNA, 482 bp, Homo sapiens
  misc_feature: HIJSMM301BQTBC.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcccttgggaccaatgtggatatcaaacgaactgtggctgcaccatctgtt

SEQ ID NO: 592070 - DNA, 496 bp, Homo sapiens
  misc_feature: HIJSMM301ET2TS.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcattctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 592071 - DNA, 463 bp, Homo sapiens; identical to SEQ ID NO: 535062
  misc_feature: HIJSMM301CMD6U.11.73.G07.1.454.light.4.raw

SEQ ID NO: 592072 - DNA, 444 bp, Homo sapiens; identical to SEQ ID NO: 535192
  misc_feature: HIJSMM301B94PO.5.9.A09.1.454.light.4.raw

SEQ ID NO: 592073 - DNA, 501 bp, Homo sapiens; identical to SEQ ID NO: 540528
  misc_feature: HIJSMM301CABNJ.11.31.C09.1.454.light.4.raw

SEQ ID NO: 592074 - DNA, 502 bp, Homo sapiens
  misc_feature: HIJSMM301D5TQE.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcactc

SEQ ID NO: 592075 - DNA, 498 bp, Homo sapiens
  misc_feature: HIJSMM301BWPZP.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaacccc

SEQ ID NO: 592076 - DNA, 503 bp, Homo sapiens; identical to SEQ ID NO: 550542
  misc_feature: HIJSMM301AHSYE.2.76.G10.1.454.light.4.raw

SEQ ID NO: 592077 - DNA, 519 bp, Homo sapiens
  misc_feature: HIJSMM301DNX3U.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctcccagacccgggggacgaggcccgattattactgcgcaacttgggactccaacctgactgttggggctttcggcggagggactaagttgaccgtcctacgtcagcccaaggctgcccctcggtcactctgttcccaccctcctccactactatg

SEQ ID NO: 592078 - DNA, 514 bp, Homo sapiens; identical to SEQ ID NO: 543870
  misc_feature: HIJSMM301DAZ9I.40.12.B01.1.454.light.4.raw

SEQ ID NO: 592079 - DNA, 479 bp, Homo sapiens
  misc_feature: HIJSMM301DO7TV.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggaggggaccgcggtggagatcagacgaactgtggctgcaccatctgtctt

SEQ ID NO: 592080 - DNA, 487 bp, Homo sapiens
  misc_feature: HIJSMM301CX7CO.5.41.D08.1.454.light.4.raw
atcagacacgcacgaccggtgctcgatttagtcacgcgagaaagggaaagggggatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaaaccctattcactttcggccctgggaccagagtggatatcaaacgaactgt

SEQ ID NO: 592081 - DNA, 459 bp, Homo sapiens; identical to SEQ ID NO: 553966
  misc_feature: HIJSMM301B9Z6U.5.14.B03.1.454.light.4.raw

SEQ ID NO: 592082 - DNA, 447 bp, Homo sapiens; identical to SEQ ID NO: 535201
  misc_feature: HIJSMM301B2JBH.18.9.A09.1.454.light.4.raw

SEQ ID NO: 592083 - DNA, 495 bp, Homo sapiens
  misc_feature: HIJSMM301AICN4.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctcgggaccagagtggatatcaaacgaactgtggctgcaccatctgtcttcactcttcccg

SEQ ID NO: 592084 - DNA, 455 bp, Homo sapiens; identical to SEQ ID NO: 551110
  misc_feature: HIJSMM301C67D8.19.86.H09.1.454.light.4.raw

SEQ ID NO: 592085 - DNA, 490 bp, Homo sapiens; identical to SEQ ID NO: 569106
  misc_feature: HIJSMM301AM0R0.51.55.E11.1.454.light.4.raw

SEQ ID NO: 592086 - DNA, 508 bp, Homo sapiens
  misc_feature: HIJSMM301DTXOG.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcatgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactc

SEQ ID NO: 592087 - DNA, 507 bp, Homo sapiens; identical to SEQ ID NO: 535930
  misc_feature: HIJSMM301BEED3.15.34.D01.1.454.light.4.raw

SEQ ID NO: 592088 - DNA, 512 bp, Homo sapiens; identical to SEQ ID NO: 584588
  misc_feature: HIJSMM301ASYB9.4.71.G05.1.454.light.4.raw

SEQ ID NO: 592089 - DNA, 507 bp, Homo sapiens
  misc_feature: HIJSMM301EKMZI.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggaccggtggaataaaacgaactgtggctgcaccatctgtcttcatt

SEQ ID NO: 592090 - DNA, 444 bp, Homo sapiens
  misc_feature: HIJSMM301CXJOA.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattactactgtctgtcctatgacgacgacctacagactccggttttcggcggagggactaagctgaccgtcctaagtcagcccaaggctgccccctcggtcactctgttcccgccctcctcgtatctctcg

SEQ ID NO: 592091 - DNA, 494 bp, Homo sapiens; identical to SEQ ID NO: 534992
  misc_feature: HIJSMM301D9CGR.9.1.A01.1.454.light.4.raw

SEQ ID NO: 592092 - DNA, 502 bp, Homo sapiens
  misc_feature: HIJSMM301D0ZZD.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaagggaccgaaggtggaaatcaaacgaactgtggctgcaccatctgtcttcta

SEQ ID NO: 592093 - DNA, 498 bp, Homo sapiens
  misc_feature: HIJSMM301AMRGJ.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctatgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgcc

SEQ ID NO: 592094 - DNA, 497 bp, Homo sapiens; identical to SEQ ID NO: 535664
  misc_feature: HIJSMM301CU6E3.22.14.B03.1.454.light.4.raw

SEQ ID NO: 592095 - DNA, 497 bp, Homo sapiens; identical to SEQ ID NO: 535740
  misc_feature: HIJSMM301A73XR.3.71.G05.1.454.light.4.raw

SEQ ID NO: 592096 - DNA, 487 bp, Homo sapiens; identical to SEQ ID NO: 536206
  misc_feature: HIJSMM301BE1MI.47.38.D05.1.454.light.4.raw

SEQ ID NO: 592097 - DNA, 479 bp, Homo sapiens; identical to SEQ ID NO: 539141
  misc_feature: HIJSMM301BI3RA.7.67.G01.1.454.light.4.raw

SEQ ID NO: 592098 - DNA, 520 bp, Homo sapiens
  misc_feature: HIJSMM301DYDAA.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctcgttcccaccctcctc

SEQ ID NO: 592099 - DNA, 513 bp, Homo sapiens
  misc_feature: HIJSMM301C1CXB.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctatttggcggagggaccaagctgaccgtcttaagtcagcccaaggctgccccctcggtcactctgttcccgccctcct

SEQ ID NO: 592100 - DNA, 476 bp, Homo sapiens; identical to SEQ ID NO: 537368
  misc_feature: HIJSMM301B07MX.7.83.H06.1.454.light.4.raw

SEQ ID NO: 592101 - DNA, 506 bp, Homo sapiens
  misc_feature: HIJSMM301AE83B.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatcaaaacgaactagtggctgcaccatctgtcttcatccttccccg

SEQ ID NO: 592102 - DNA, 497 bp, Homo sapiens; identical to SEQ ID NO: 535664
  misc_feature: HIJSMM301EEQPL.22.14.B03.1.454.light.4.raw

SEQ ID NO: 592103 - DNA, 520 bp, Homo sapiens; identical to SEQ ID NO: 539176
  misc_feature: HIJSMM301CF1MO.27.23.C01.1.454.light.4.raw

SEQ ID NO: 592104 - DNA, 483 bp, Homo sapiens; identical to SEQ ID NO: 535413
  misc_feature: HIJSMM301B5GY5.26.78.H01.1.454.light.4.raw

SEQ ID NO: 592105 - DNA, 485 bp, Homo sapiens; identical to SEQ ID NO: 535688
  misc_feature: HIJSMM301DYQPT.19.5.A05.1.454.light.4.raw

SEQ ID NO: 592106 - DNA, 497 bp, Homo sapiens
  misc_feature: HIJSMM301EO0HN.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagtattttgctagtttattactgtcagcagcgtagcaacctcctcacgttcggcggagggaccgaaggtggagatacaaaccgaactgtggctgcaccatctgtctcatctcccgc

SEQ ID NO: 592107 - DNA, 506 bp, Homo sapiens; identical to SEQ ID NO: 534969
  misc_feature: HIJSMM301A2NFQ.18.37.D04.1.454.light.4.raw

SEQ ID NO: 592108 - DNA, 492 bp, Homo sapiens
  misc_feature: HIJSMM301AQVB0.40.37.D04.1.454.light.4.raw
tctagcgactcacgaccggtgctcgatttagtagcatactgttgggtttgggggactgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcggtccctcggaccgagagtggagtgtcaaacgtaacg

SEQ ID NO: 592109 - DNA, 505 bp, Homo sapiens
  misc_feature: HIJSMM301BLV53.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaaagctgaggatgaggctgattattactgcagctcatatgcaggcagcagcaatgtacttttcggcggagggaccaaagctgaccgtcctgggtcagcccaaggctgccccctcggtca

SEQ ID NO: 592110 - DNA, 507 bp, Homo sapiens
  misc_feature: HIJSMM301A53ZY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaaggtggaaagtcaaacgaactagtggctgcaccatctgtcttcatcttccccg

SEQ ID NO: 592111 - DNA, 486 bp, Homo sapiens; identical to SEQ ID NO: 535385
  misc_feature: HIJSMM301BF68L.19.71.G05.1.454.light.4.raw

SEQ ID NO: 592112 - DNA, 481 bp, Homo sapiens; identical to SEQ ID NO: 535993
  misc_feature: HIJSMM301ANJ3G.21.25.C03.1.454.light.4.raw

SEQ ID NO: 592113 - DNA, 454 bp, Homo sapiens; identical to SEQ ID NO: 534964
  misc_feature: HIJSMM301E0EQ6.19.86.H09.1.454.light.4.raw

SEQ ID NO: 592114 - DNA, 484 bp, Homo sapiens; identical to SEQ ID NO: 535240
  misc_feature: HIJSMM301DKP2K.47.60.F05.1.454.light.4.raw

SEQ ID NO: 592115 - DNA, 478 bp, Homo sapiens; identical to SEQ ID NO: 544596
  misc_feature: HIJSMM301C7GQ7.21.25.C03.1.454.light.4.raw

SEQ ID NO: 592116 - DNA, 491 bp, Homo sapiens
  misc_feature: HIJSMM301EM6CB.41.16.B05.1.454.light.4.raw
tctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttgccagggaccaagctcgagatcaaacgaactgtggctgcaccatctgtcttcatcttcccg

SEQ ID NO: 592117 - DNA, 499 bp, Homo sapiens; identical to SEQ ID NO: 536187
  misc_feature: HIJSMM301BJ1I4.11.67.G01.1.454.light.4.raw

SEQ ID NO: 592118 - DNA, 501 bp, Homo sapiens
  misc_feature: HIJSMM301CMF9Z.17.86.H09.1.454.light.4.raw
cgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagtgcttataactatgtctcctggtaccaacagcacccaggcaaggtccccaaagccatgatttatgaggtcagtaatcggccctcaggggtttctaatcgcttctctggctccaagtctggcaacacggcctccctcaccatctctggactccagcctgaggacgaggctgattattactgcatctcatttgtaagcagtagccttgtgttattcggcggagggaccaagctgaccgtcctgggtcagcccaaggctgccccccg

SEQ ID NO: 592119 - DNA, 496 bp, Homo sapiens; identical to SEQ ID NO: 535109
  misc_feature: HIJSMM301D556B.16.78.H01.1.454.light.4.raw

SEQ ID NO: 592120 - DNA, 523 bp, Homo sapiens
  misc_feature: HIJSMM301AY2WK.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagagtaagccctctcgtggttttcgcgggggaccaaggtgaccgtcctaagtcagcccaaggctgccccctcggtcactctgttcccgccctcctctacg

SEQ ID NO: 592121 - DNA, 477 bp, Homo sapiens; identical to SEQ ID NO: 535506
  misc_feature: HIJSMM301D9QDQ.7.67.G01.1.454.light.4.raw

SEQ ID NO: 592122 - DNA, 496 bp, Homo sapiens
  misc_feature: HIJSMM301C6CV0.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcctac

SEQ ID NO: 592123 - DNA, 513 bp, Homo sapiens; identical to SEQ ID NO: 579891
  misc_feature: HIJSMM301AWHLQ.14.7.A07.1.454.light.4.raw

SEQ ID NO: 592124 - DNA, 506 bp, Homo sapiens; identical to SEQ ID NO: 563474
  misc_feature: HIJSMM301EDVQ4.10.27.C05.1.454.light.4.raw

SEQ ID NO: 592125 - DNA, 482 bp, Homo sapiens; identical to SEQ ID NO: 540658
  misc_feature: HIJSMM301EK1I5.16.81.H04.1.454.light.4.raw

SEQ ID NO: 592126 - DNA, 493 bp, Homo sapiens; identical to SEQ ID NO: 535745
  misc_feature: HIJSMM301E234U.47.78.H01.1.454.light.4.raw

SEQ ID NO: 592127 - DNA, 494 bp, Homo sapiens
  misc_feature: HIJSMM301DYYN6.40.11.A11.1.454.light.4.raw
tctagcgactcacgaccggtgctcgatttagctacgactgcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgcc

SEQ ID NO: 592128 - DNA, 503 bp, Homo sapiens
  misc_feature: HIJSMM301C99LL.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactagtggctgcaccatctgtcttcat

SEQ ID NO: 592129 - DNA, 488 bp, Homo sapiens
  misc_feature: HIJSMM301CAPFT.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggccgcaccatct

SEQ ID NO: 592130 - DNA, 493 bp, Homo sapiens
  misc_feature: HIJSMM301E03FW.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccact

SEQ ID NO: 592131 - DNA, 464 bp, Homo sapiens
  misc_feature: HIJSMM301CONH9.26.78.H01.1.454.light.4.raw
  modified_base (458)..(458): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgaagtntagtct

SEQ ID NO: 592132 - DNA, 510 bp, Homo sapiens
  misc_feature: HIJSMM301CO3YA.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcact

SEQ ID NO: 592133 - DNA, 506 bp, Homo sapiens; identical to SEQ ID NO: 535058
  misc_feature: HIJSMM301CL2ZS.17.41.D08.1.454.light.4.raw

SEQ ID NO: 592134 - DNA, 509 bp, Homo sapiens
  misc_feature: HIJSMM301C7XVF.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccaaggctgccccctcggtcactctgttcccg

SEQ ID NO: 592135 - DNA, 505 bp, Homo sapiens
  misc_feature: HIJSMM301AHRKR.48.38.D05.1.454.light.4.raw
agtatacatacacgaccggtgctcgatttagtatctgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatccttccccg

SEQ ID NO: 592136 - DNA, 487 bp, Homo sapiens; identical to SEQ ID NO: 535704
  misc_feature: HIJSMM301CKAXP.52.83.H06.1.454.light.4.raw

SEQ ID NO: 592137 - DNA, 492 bp, Homo sapiens
  misc_feature: HIJSMM301EATDR.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgcccaaccgtatagtacttattcggtcaccttcggaccaagggacacgactggagattaaacgaactgtggctgcaccatctgtctt

SEQ ID NO: 592138 - DNA, 452 bp, Homo sapiens
  misc_feature: HIJSMM301BI657.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgacgtcctaagtcagcccaaggctgccccctcggtcactctgttcccaccctcctccacgagata

SEQ ID NO: 592139 - DNA, 494 bp, Homo sapiens
  misc_feature: HIJSMM301B6VLJ.52.32.C10.1.454.light.4.raw
cgcagtacgacacgaccggtgctcgatttagtatagacatcaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataagacactgagaggccctcagggatccctgagcgattctctggctccaggtcagggacaacggtcacattggccatcagtggagtccaggcagaggacgaggctgactattattgtcaatcaaacagacaccattggtacttatgtcttcggaactgcgaccaaggtcaccgtcctgggtcagcccaaggccaaccccactgt

SEQ ID NO: 592140 - DNA, 512 bp, Homo sapiens
  misc_feature: HIJSMM301CUK61.51.38.D05.1.454.light.4.raw
cgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctcg

SEQ ID NO: 592141 - DNA, 504 bp, Homo sapiens
  misc_feature: HIJSMM301D6IUF.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatggacaacctgggtgcttatctcttcggacctgggaccaaggtcaccgtccttggt

SEQ ID NO: 592142 - DNA, 504 bp, Homo sapiens; identical to SEQ ID NO: 535561
  misc_feature: HIJSMM301BD0NG.4.57.F02.1.454.light.4.raw

SEQ ID NO: 592143 - DNA, 444 bp, Homo sapiens; identical to SEQ ID NO: 535192
  misc_feature: HIJSMM301BG6OG.5.9.A09.1.454.light.4.raw

SEQ ID NO: 592144 - DNA, 492 bp, Homo sapiens
  misc_feature: HIJSMM301DIC5H.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaaacgaactgtgg

SEQ ID NO: 592145 - DNA, 481 bp, Homo sapiens
  misc_feature: HIJSMM301D6SIQ.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcacatctgtt

SEQ ID NO: 592146 - DNA, 491 bp, Homo sapiens
  misc_feature: HIJSMM301D3PTC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatcttcg

SEQ ID NO: 592147 - DNA, 503 bp, Homo sapiens; identical to SEQ ID NO: 543231
  misc_feature: HIJSMM301AD0H8.5.86.H09.1.454.light.4.raw

SEQ ID NO: 592148 - DNA, 501 bp, Homo sapiens
  misc_feature: HIJSMM301CQS6P.48.69.G03.1.454.light.4.raw
agtatacatacacgaccggtgctcgatttagtcgctgcgtaaaggagaaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatt

SEQ ID NO: 592149 - DNA, 489 bp, Homo sapiens
  misc_feature: HIJSMM301BVS7K.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggtacgttcggtccaagggaccaaggtggataatcagacgaa

SEQ ID NO: 592150 - DNA, 479 bp, Homo sapiens
  misc_feature: HIJSMM301A8Z8H.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccaagctgaccgtcctaagtcagaccccg

SEQ ID NO: 592151 - DNA, 507 bp, Homo sapiens
  misc_feature: HIJSMM301ELZA0.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcaacgggacgcaacatgggatgacaatctgagcggttgggtgtttcgggcggagggaccaaactgaaccgtcctaggtcaagcccaa

SEQ ID NO: 592152 - DNA, 501 bp, Homo sapiens
  misc_feature: HIJSMM301DU6HT.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaacgcccccaaactcattatttatgaagtcactaagccggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtctgggtcagcccaaggctgccccctcggtcactctcgttcccaccctcctctgtcgagcgt

SEQ ID NO: 592153 - DNA, 479 bp, Homo sapiens
  misc_feature: HIJSMM301ER6W0.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctggacgttcggccaaggacgaacggtaggaaatcaaacgaactgtggctgcacc

SEQ ID NO: 592154 - DNA, 447 bp, Homo sapiens; identical to SEQ ID NO: 535201
  misc_feature: HIJSMM301BJR5J.18.9.A09.1.454.light.4.raw

SEQ ID NO: 592155 - DNA, 490 bp, Homo sapiens
  misc_feature: HIJSMM301AC83V.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttggcggagggacgaaggtggagatacaacgaactgtggctgcaccatctgtcttc

SEQ ID NO: 592156 - DNA, 480 bp, Homo sapiens
  misc_feature: HIJSMM301CBBY6.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacatattattatacttcgtggacgttcgccaagggaccaaggtggatatcagagaa

SEQ ID NO: 592157 - DNA, 494 bp, Homo sapiens
  misc_feature: HIJSMM301A7Q0S.49.69.G03.1.454.light.4.raw
agtcgagagacacgaccggtgctcgatttagtcgctgcgtaaaggagaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtatattactgtcagcatgggagcattcgtgcgctcaccttcggcggagggaccaaggtggagatcaaacgaactgtggctgcaccatctgtctt

SEQ ID NO: 592158 - DNA, 470 bp, Homo sapiens; identical to SEQ ID NO: 555914
  misc_feature: HIJSMM301BKLWN.4.79.H02.1.454.light.4.raw

SEQ ID NO: 592159 - DNA, 520 bp, Homo sapiens
  misc_feature: HIJSMM301ADNWF.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggaggggaccgaaaactaagaggtacgaaacgaaccgtagtggcgtgtcgaccactactgtctttctactt

SEQ ID NO: 592160 - DNA, 504 bp, Homo sapiens
  misc_feature: HIJSMM301EWHNX.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcagggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtctaggtcagcccaaggctcgcccctcggtcta

SEQ ID NO: 592161 - DNA, 509 bp, Homo sapiens
  misc_feature: HIJSMM301D1GJN.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcgttcggccgaagggaccgaaggtaggaagtacaaacgaactagtggctgcaccatctgtcttcatcttccccg

SEQ ID NO: 592162 - DNA, 500 bp, Homo sapiens
  misc_feature: HIJSMM301DATYQ.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtccaggtcagccaaggctgccccctc

SEQ ID NO: 592163 - DNA, 488 bp, Homo sapiens; identical to SEQ ID NO: 537673
  misc_feature: HIJSMM301A0HQC.12.31.C09.1.454.light.4.raw

SEQ ID NO: 592164 - DNA, 479 bp, Homo sapiens
  misc_feature: HIJSMM301DKB8I.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggac

SEQ ID NO: 592165 - DNA, 483 bp, Homo sapiens
  misc_feature: HIJSMM301C5UYI.48.49.E05.1.454.light.4.raw
agtatacatacacgaccggtgctcgatttagagcgactagcaactacgaaagggggagtcagacccacctcaggacacagcatggacatgagggtccccgcctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgactgtggctgca

SEQ ID NO: 592166 - DNA, 495 bp, Homo sapiens; identical to SEQ ID NO: 541961
  misc_feature: HIJSMM301CYJGL.21.27.C05.1.454.light.4.raw
  modified_base (198)..(198): a, c, t, g, unknown or other

SEQ ID NO: 592167 - DNA, 480 bp, Homo sapiens
  misc_feature: HIJSMM301BD3UJ.49.30.C08.1.454.light.4.raw
  modified_base (454)..(454): a, c, t, g, unknown or other
agtcgagagacacgaccggtgctcgatttagtctgacgtcaaagggaaaggggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgctcactttcggcgggggacccgaaggtggnggaatcaagcgaactgtggctgcacc

SEQ ID NO: 592168 - DNA, 485 bp, Homo sapiens; identical to SEQ ID NO: 544818
  misc_feature: HIJSMM301CRE4O.13.36.D03.1.454.light.4.raw

SEQ ID NO: 592169 - DNA, 479 bp, Homo sapiens
  misc_feature: HIJSMM301A4NYZ.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtatcatccagatgacccagtccccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccgaaggtggagatcagacgaaactgtggctgcaccta

SEQ ID NO: 592170 - DNA, 514 bp, Homo sapiens
  misc_feature: HIJSMM301EH5F0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccgaagggaccgaaggtaggaaagtacaaaacggaactagtggctggcaccatctgtcttctatcttccccg

SEQ ID NO: 592171 - DNA, 496 bp, Homo sapiens
  misc_feature: HIJSMM301EML9Y.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacgcaggttcagtggcagtgggtctgggacagacttcagtctcaccatcagcagcctagagcctgaggattttgcaatttatttctgtcaacagcgtagcacctggccccggtcaccttcggccaagggacacgactggacatgaaacgaactgtggctgcaccatctgtcttca

SEQ ID NO: 592172 - DNA, 488 bp, Homo sapiens
  misc_feature: HIJSMM301C67U7.15.49.E05.1.454.light.4.raw
tctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactgtggctgcaccatct

SEQ ID NO: 592173 - DNA, 444 bp, Homo sapiens
  misc_feature: HIJSMM301AQ3SK.18.9.A09.1.454.light.4.raw
tacgagtatgcacgaccggtgctcgatttagcgagacgcgcagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 592174 - DNA, 511 bp, Homo sapiens
  misc_feature: HIJSMM301DUNLH.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcgagggaccaagttgaccgtcctaagtcagcccaaggctgccccctcggtcactctgtt

SEQ ID NO: 592175 - DNA, 482 bp, Homo sapiens
  misc_feature: HIJSMM301BFF5T.48.22.B11.1.454.light.4.raw
agtatacatacacgaccggtgctcgatttagacgacagctcaggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccagggaccaaggtggagatcaaacgaactgtggctgcaccatctgt

SEQ ID NO: 592176 - DNA, 498 bp, Homo sapiens; identical to SEQ ID NO: 547576
  misc_feature: HIJSMM301DSD17.12.37.D04.1.454.light.4.raw

SEQ ID NO: 592177 - DNA, 522 bp, Homo sapiens
  misc_feature: HIJSMM301ALB7U.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccggtcctaggtcagcccaaggctgccccctcggtcactctgttcccaccct

SEQ ID NO: 592178 - DNA, 523 bp, Homo sapiens
  misc_feature: HIJSMM301CRG4V.27.23.C01.1.454.light.4.raw
  modified_base (519)..(519): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgttagttcatatacaaccagtgacacttgggtgttcggcggagggaccaggctgaccgtcctaggtcagcccaaggctgccccctcggtccactctgttcccnccct

SEQ ID NO: 592179 - DNA, 489 bp, Homo sapiens; identical to SEQ ID NO: 536919
  misc_feature: HIJSMM301CN3MP.22.86.H09.1.454.light.4.raw

SEQ ID NO: 592180 - DNA, 481 bp, Homo sapiens
  misc_feature: HIJSMM301EP9VO.43.12.B01.1.454.light.4.raw
tgtgagtagtcacgaccggtgctcgatttagtagtgtagattccgcggggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggcccaagggacacgactggacattaaacgaactgtggctgcacc

SEQ ID NO: 592181 - DNA, 521 bp, Homo sapiens; identical to SEQ ID NO: 539470
  misc_feature: HIJSMM301DN3W9.27.23.C01.1.454.light.4.raw

SEQ ID NO: 592182 - DNA, 499 bp, Homo sapiens; identical to SEQ ID NO: 542528
  misc_feature: HIJSMM301AZBXT.52.34.D01.1.454.light.4.raw

SEQ ID NO: 592183 - DNA, 449 bp, Homo sapiens
  misc_feature: HIJSMM301DJOZH.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatttgggaccaaggtcaccgtcctaagtcagcccaacggccaacccctcctgtcactctgttcccaccctcctccatactcgta

SEQ ID NO: 592184 - DNA, 478 bp, Homo sapiens; identical to SEQ ID NO: 535129
  misc_feature: HIJSMM301AT5CT.11.11.A11.1.454.light.4.raw

SEQ ID NO: 592185 - DNA, 501 bp, Homo sapiens; identical to SEQ ID NO: 535873
  misc_feature: HIJSMM301AW57N.17.27.C05.1.454.light.4.raw

SEQ ID NO: 592186 - DNA, 491 bp, Homo sapiens; identical to SEQ ID NO: 565902
  misc_feature: HIJSMM301DA1VB.22.65.F10.1.454.light.4.raw

SEQ ID NO: 592187 - DNA, 486 bp, Homo sapiens
  misc_feature: HIJSMM301A7X8M.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtacaacaatattattatacttcgtggacgttcggccaagggaccaaggtggatatcagacgaa

SEQ ID NO: 592188 - DNA, 466 bp, Homo sapiens; identical to SEQ ID NO: 535366
  misc_feature: HIJSMM301CAG15.13.4.A04.1.454.light.4.raw

SEQ ID NO: 592189 - DNA, 489 bp, Homo sapiens; identical to SEQ ID NO: 535139
  misc_feature: HIJSMM301D6JCX.14.55.E11.1.454.light.4.raw

SEQ ID NO: 592190 - DNA, 486 bp, Homo sapiens; identical to SEQ ID NO: 535043
  misc_feature: HIJSMM301ECGYA.46.35.D02.1.454.light.4.raw

SEQ ID NO: 592191 - DNA, 505 bp, Homo sapiens
  misc_feature: HIJSMM301DEO8Y.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccaccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtcta

SEQ ID NO: 592192 - DNA, 503 bp, Homo sapiens
  misc_feature: HIJSMM301DF6YY.41.38.D05.1.454.light.4.raw
tctatactatcacgaccggtgctcgatttagtatctgatagttgggtttggggggagccagacccagtcaggacacagcacggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgactagtttccctctcactttcggcggagggaccaaggttgagaccaaacgaactgtggctgcacatctgtctctatcttccccg

SEQ ID NO: 592193 - DNA, 518 bp, Homo sapiens
  misc_feature: HIJSMM301C8XX3.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccct

SEQ ID NO: 592194 - DNA, 502 bp, Homo sapiens
  misc_feature: HIJSMM301B1DTL.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtccact

SEQ ID NO: 592195 - DNA, 507 bp, Homo sapiens
  misc_feature: HIJSMM301EIUPK.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctggcaccatctgtt

SEQ ID NO: 592196 - DNA, 475 bp, Homo sapiens
  misc_feature: HIJSMM301DZZKJ.3.2.A02.1.454.light.4.raw
agacgcactccacgaccggtgctcgatttagactcatctacaggggagtcagtctcagtcaggacacagcatggacatgagggtccccgctcagctcctggggctcctgctactctggctccgaggtgccagatgtgacatccagatgacccagtctccttcctccctgtctgcatctgtgggagacagagtcaccctcacttgccggccaagtcacagcattagcatctatttaaattggtatcaacagaagccagggaaagcccctaacctcctgatctatactgcatccagtttgcaaagtggagtcccatcaaggttcagtggcagtggatctgggacagagttcactctcaccatcagcagtctgcaacctgaagattttgcagcttactactgtcaacagagttacagtatccctccaaccttcggcggagggaccaaggtggagatacaaacgaactgtggctgcacc

SEQ ID NO: 592197 - DNA, 513 bp, Homo sapiens
  misc_feature: HIJSMM301BM5I5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggaccgaacggtaggaagtacaacgaactacgtaggcgtgcaccatctgtcttctactcttcccgtcccact

SEQ ID NO: 592198 - DNA, 503 bp, Homo sapiens
  misc_feature: HIJSMM301BTYNY.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttggaactgggaccaaggtcaccgtcctaggtcagcccaaggccaacccactgtca

SEQ ID NO: 592199 - DNA, 486 bp, Homo sapiens; identical to SEQ ID NO: 553608
  misc_feature: HIJSMM301EN35Z.11.12.B01.1.454.light.4.raw

SEQ ID NO: 592200 - DNA, 496 bp, Homo sapiens; identical to SEQ ID NO: 561995
  misc_feature: HIJSMM301CZDUZ.16.78.H01.1.454.light.4.raw

SEQ ID NO: 592201 - DNA, 494 bp, Homo sapiens
  misc_feature: HIJSMM301A6PO8.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctagtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 592202 - DNA, 512 bp, Homo sapiens
  misc_feature: HIJSMM301E0UHV.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggtttcagtggcagtgggtctgggacagacttcattctcaccatccgcagcctagagcctgaagattttgcagtttattactgtcaacagcgtagcagcaggcctccggcgacgttcggccaaggaccgaaggtggaagtcaagcgaactgtggctgcaccatctgtcttcatcttcccgccatc

SEQ ID NO: 592203 - DNA, 449 bp, Homo sapiens
  misc_feature: HIJSMM301CPMZ0.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattttggctgttcggcggcgggaccaagttgaccgtcctacgtcagcccaaggctgccccctccggtcactctgttcccaccctccctccgacaccgcgag

SEQ ID NO: 592204 - DNA, 494 bp, Homo sapiens; identical to SEQ ID NO: 534994
  misc_feature: HIJSMM301A829K.27.78.H01.1.454.light.4.raw

SEQ ID NO: 592205 - DNA, 487 bp, Homo sapiens; identical to SEQ ID NO: 540408
  misc_feature: HIJSMM301CZ069.41.33.C11.1.454.light.4.raw

SEQ ID NO: 592206 - DNA, 539 bp, Homo sapiens
  misc_feature: HIJSMM301DOVPV.41.30.C08.1.454.light.4.raw
tctatactatcacgaccggtgctcgatttagtctgacgtcaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggccaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactggggaccagggtcaccgtacctacggtacgtacgaccgaccggaaccgaccccaaccctacgtcgactacctcgttccccg

SEQ ID NO: 592207 - DNA, 513 bp, Homo sapiens
  misc_feature: HIJSMM301A63VC.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaacccccactgtcactcctgttcccaccct

SEQ ID NO: 592208 - DNA, 501 bp, Homo sapiens; identical to SEQ ID NO: 572732
  misc_feature: HIJSMM301CPEO2.11.21.B10.1.454.light.4.raw

SEQ ID NO: 592209 - DNA, 477 bp, Homo sapiens
  misc_feature: HIJSMM301EK3FY.52.73.G07.1.454.light.4.raw
cgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaaggctggagatcaaacgaa

SEQ ID NO: 592210 - DNA, 503 bp, Homo sapiens
  misc_feature: HIJSMM301DVI8K.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctcaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 592211 - DNA, 485 bp, Homo sapiens
  misc_feature: HIJSMM301DV4PS.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacatcggccctgggaccaaagtggagatcaaacgaa

SEQ ID NO: 592212 - DNA, 447 bp, Homo sapiens; identical to SEQ ID NO: 535201
  misc_feature: HIJSMM301BVQ7H.18.9.A09.1.454.light.4.raw

SEQ ID NO: 592213 - DNA, 479 bp, Homo sapiens
  misc_feature: HIJSMM301B9Y3W.49.35.D02.1.454.light.4.raw
agtcgagagacacgaccggtgctcgatttagcacacgatagttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttctaccatcagcggcctgcagcctgaagattttgcaacatattactgtcaacagtatgaagatctcccactcactttcggcggagggaccgaaggtggagatcagacgaactgtggctgcacca

SEQ ID NO: 592214 - DNA, 521 bp, Homo sapiens; identical to SEQ ID NO: 539470
  misc_feature: HIJSMM301EFYZP.27.23.C01.1.454.light.4.raw

SEQ ID NO: 592215 - DNA, 493 bp, Homo sapiens
  misc_feature: HIJSMM301BH0FW.51.12.B01.1.454.light.4.raw
cgatcgtatacacgaccggtgctcgatttagtagtgtagattccgcgggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattaggtacttatgtcttcggaactgcgaccaaggtcaccgtctgggtcagcccaaggccaacccactgtcact

SEQ ID NO: 592216 - DNA, 447 bp, Homo sapiens; identical to SEQ ID NO: 535201
  misc_feature: HIJSMM301B9O9K.18.9.A09.1.454.light.4.raw

SEQ ID NO: 592217 - DNA, 503 bp, Homo sapiens
  misc_feature: HIJSMM301D6CQU.41.80.H03.1.454.light.4.raw
tctatactatcacgaccggtgctcgatttagctgtgcgtcgaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggaccgaagctgaccgtcctaggtcagcccaaggctgccccctcggtctacc

SEQ ID NO: 592218 - DNA, 440 bp, Homo sapiens; identical to SEQ ID NO: 537628
  misc_feature: HIJSMM301EFWHZ.41.9.A09.1.454.light.4.raw

SEQ ID NO: 592219 - DNA, 514 bp, Homo sapiens
  misc_feature: HIJSMM301A6K95.48.12.B01.1.454.light.4.raw
agtatacatacacgaccggtgctcgatttagtagtgtagattccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgttttttaaacgggagtctggggtcccagacagattcagcggcagtgggtcagacactgacttcacactgagaatcagcagggttgaggctgaggatgttggcacttattactgcatgcaaggctcacactggcctccgtggacgtcggccaagggacccgggtgggaaagtaaaacgaaacctagtggcgtgcaccactctgtcttc

SEQ ID NO: 592220 - DNA, 503 bp, Homo sapiens
  misc_feature: HIJSMM301BGO8L.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggtttcccgctgactttcggcggagggaccaaggtagagatcaaaggaactgtggctgcaccatctgtcttcatcttcccgccta

SEQ ID NO: 592221 - DNA, 497 bp, Homo sapiens
  misc_feature: HIJSMM301EAVY9.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgttcagcagtatagtaactggcctccgtacacttttggccaggggaccaagctagaaatcaaacgaactgtggctgcaccatctgtcttcta

SEQ ID NO: 592222 - DNA, 472 bp, Homo sapiens; identical to SEQ ID NO: 536302
  misc_feature: HIJSMM301DTH1O.18.76.G10.1.454.light.4.raw

SEQ ID NO: 592223 - DNA, 474 bp, Homo sapiens
  misc_feature: HIJSMM301AQQW2.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagtattttgctagtttattactgtcagcaatataacaagtggccattcactttcggccagggaccaaagtggatatacaaacgaactgtggctgcaccatctgtcttcatcttcccgccat

SEQ ID NO: 592224 - DNA, 513 bp, Homo sapiens; identical to SEQ ID NO: 583823
  misc_feature: HIJSMM301DGU0O.43.23.C01.1.454.light.4.raw

SEQ ID NO: 592225 - DNA, 492 bp, Homo sapiens; identical to SEQ ID NO: 552519
  misc_feature: HIJSMM301CHE0G.10.72.G06.1.454.light.4.raw

SEQ ID NO: 592226 - DNA, 521 bp, Homo sapiens; identical to SEQ ID NO: 539470
  misc_feature: HIJSMM301AJVXK.27.23.C01.1.454.light.4.raw

SEQ ID NO: 592227 - DNA, 492 bp, Homo sapiens; identical to SEQ ID NO: 536010
  misc_feature: HIJSMM301CGWP2.10.20.B09.1.454.light.4.raw

SEQ ID NO: 592228 - DNA, 498 bp, Homo sapiens
  misc_feature: HIJSMM301DUDLB.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctcgttcccaccctcctc

SEQ ID NO: 592229 - DNA, 473 bp, Homo sapiens
  misc_feature: HIJSMM301A4NNR.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtaggatatcaaacgaactgtggctgcaccatctgtcttcatcttcccgccat

SEQ ID NO: 592230 - DNA, 480 bp, Homo sapiens; identical to SEQ ID NO: 556526
  misc_feature: HIJSMM301CAAZ4.11.76.G10.1.454.light.4.raw

SEQ ID NO: 592231 - DNA, 486 bp, Homo sapiens; identical to SEQ ID NO: 536323
  misc_feature: HIJSMM301EQ99C.10.2.A02.1.454.light.4.raw

SEQ ID NO: 592232 - DNA, 520 bp, Homo sapiens; identical to SEQ ID NO: 539176
  misc_feature: HIJSMM301CK777.27.23.C01.1.454.light.4.raw

SEQ ID NO: 592233 - DNA, 499 bp, Homo sapiens
  misc_feature: HIJSMM301DOPTZ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaacgaactgtggctgcaccatct

SEQ ID NO: 592234 - DNA, 447 bp, Homo sapiens
  misc_feature: HIJSMM301CTQ8S.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgacttattactgccagtcctatgacatgaggctgagtggttcgtatgtcttcggatctgggaccaaggtcaccgtcctaagtcagccaaggccaacccctctgtcactctgttcccaccctcctccatactcgta

SEQ ID NO: 592235 - DNA, 497 bp, Homo sapiens
  misc_feature: HIJSMM301CAB8J.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcagggcactgatttcacactgaagatcagcagggtggaggctgaggatgttggggtttattactgcatgcaaggtacacactggcccgtcaccttcggccaagggacacgactggagattaaacgaactgtggctgcacc

SEQ ID NO: 592236 - DNA, 490 bp, Homo sapiens
  misc_feature: HIJSMM301BH21B.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactaatgtcaacagacttacagtgcccccccgatcaccttcggccaagggacacgactggagattaaacgaactgtggctgcaccatctgtcttcat

SEQ ID NO: 592237 - DNA, 520 bp, Homo sapiens; identical to SEQ ID NO: 539176
  misc_feature: HIJSMM301COLHN.27.23.C01.1.454.light.4.raw

SEQ ID NO: 592238 - DNA, 515 bp, Homo sapiens; identical to SEQ ID NO: 557303
  misc_feature: HIJSMM301CVZYH.12.85.H08.1.454.light.4.raw

SEQ ID NO: 592239 - DNA, 505 bp, Homo sapiens
  misc_feature: HIJSMM301EQII0.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaacaaccggccctcagggatcccagaccgattctctggctcctactcaggaaacacagcttccttgaccatcactgggctcaggcggaagatgaggctgactattattgtaagtcgggacagaagtggtaatacatggtgttcggcggagggaccaagctgaccgtcctacgtcagcccaaggctgccccctcggtcactctccg

SEQ ID NO: 592240 - DNA, 469 bp, Homo sapiens
  misc_feature: HIJSMM301B7X1N.49.8.A08.1.454.light.4.raw
agtcgagagacacgaccggtgctcgatttagcatactctacaggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagtattttactttcaccatcagcagactgcagcctgaagatattgcaacatattaactgtcaacagtatgatcgcctcccgctcactttcggcgggggaccaagggtggagatcaagcgaactgtgg

SEQ ID NO: 592241 - DNA, 493 bp, Homo sapiens; identical to SEQ ID NO: 581279
  misc_feature: HIJSMM301BUHUV.9.75.G09.1.454.light.4.raw

SEQ ID NO: 592242 - DNA, 517 bp, Homo sapiens
  misc_feature: HIJSMM301ASB8K.5.27.C05.1.454.light.4.raw
  modified_base (499)..(499): a, c, t, g, unknown or other
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctggggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactcngttcccaccctcctccgt

SEQ ID NO: 592243 - DNA, 500 bp, Homo sapiens
  misc_feature: HIJSMM301DMEM5.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagcccactctgaccatcagcgggacccaggctctcgatgaggctgactattactgccaggcgtgggacagctccacttcccgttatgtcttcggaggtgggaccatggtcaccgtcctaggtcagcccaagacccaaccccactcgt

SEQ ID NO: 592244 - DNA, 490 bp, Homo sapiens
  misc_feature: HIJSMM301E23G4.4.2.A02.1.454.light.4.raw
agcactgtagcacgaccggtgctcgatttagactcatctacaggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcacttcgtcggagggacgaacggtaggagatcaaacgaactagtggcgtgcaccactactgtcttcta

SEQ ID NO: 592245 - DNA, 447 bp, Homo sapiens; identical to SEQ ID NO: 535020
  misc_feature: HIJSMM301BS3WD.18.9.A09.1.454.light.4.raw

SEQ ID NO: 592246 - DNA, 494 bp, Homo sapiens
  misc_feature: HIJSMM301B0PE9.5.3.A03.1.454.light.4.raw
atcagacacgcacgaccggtgctcgatttagagagcgtcacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactgtggtattcggcggagggaccaagctgaccgtcctaggtcagcccaaggctgccccccg

SEQ ID NO: 592247 - DNA, 488 bp, Homo sapiens
  misc_feature: HIJSMM301DXAO8.4.74.G08.1.454.light.4.raw
  modified_base (110)..(110): a, c, t, g, unknown or other
agcactgtagcacgaccggtgctcgatttagtagctctatcagggggcaggagtcagacccactcaggacacagcatggacatgagggtccccgctcagctcctggggcncctttttttgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatacaaacgaactagtggctgcacca

SEQ ID NO: 592248 - DNA, 494 bp, Homo sapiens; identical to SEQ ID NO: 534994
  misc_feature: HIJSMM301CMMOV.27.78.H01.1.454.light.4.raw

SEQ ID NO: 592249 - DNA, 494 bp, Homo sapiens; identical to SEQ ID NO: 534992
  misc_feature: HIJSMM301C5QBI.9.1.A01.1.454.light.4.raw

SEQ ID NO: 592250 - DNA, 491 bp, Homo sapiens; identical to SEQ ID NO: 538388
  misc_feature: HIJSMM301A5IHJ.51.81.H04.1.454.light.4.raw

SEQ ID NO: 592251 - DNA, 486 bp, Homo sapiens; identical to SEQ ID NO: 535043
  misc_feature: HIJSMM301BPMH3.46.35.D02.1.454.light.4.raw

SEQ ID NO: 592252 - DNA, 495 bp, Homo sapiens; identical to SEQ ID NO: 537415
  misc_feature: HIJSMM301ESJ9B.4.27.C05.1.454.light.4.raw

SEQ ID NO: 592253 - DNA, 479 bp, Homo sapiens
  misc_feature: HIJSMM301CONW5.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtctaggtcagcccaaggctgccccctcggtcactctgttcccgccctcctccgtgtctgat

SEQ ID NO: 592254 - DNA, 490 bp, Homo sapiens; identical to SEQ ID NO: 535234
  misc_feature: HIJSMM301B1LHS.17.21.B10.1.454.light.4.raw

SEQ ID NO: 592255 - DNA, 487 bp, Homo sapiens
  misc_feature: HIJSMM301BXIY8.4.36.D03.1.454.light.4.raw
agcactgtagcacgaccggtgctcgatttagctgcgtcacgatctctcttggggggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgttcggccaagggaccaaggtggaaatcaaacgaactagtggctgcaccat

SEQ ID NO: 592256 - DNA, 480 bp, Homo sapiens
  misc_feature: HIJSMM301BIZDR.41.76.G10.1.454.light.4.raw
tctatactatcacgaccggtgctcgatttagtcactcatacagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcagagtattagtggctggttggcctggtatcagcagacaccagggaaagcccctaagctcctgatccataaggcatctaatttagaaagtggggtcccatcaaggttcagcggcagtggatctgggacagaattcactctcaccatcagcagcctgcagcctgatgattttgcaacttattactgccagcaatatcatagttctccttggacgttcggtccaagggaccaaggtaggacgatcaaacgaactagtggctgcacca

SEQ ID NO: 592257 - DNA, 484 bp, Homo sapiens; identical to SEQ ID NO: 567017
  misc_feature: HIJSMM301D4RSE.19.5.A05.1.454.light.4.raw

SEQ ID NO: 592258 - DNA, 495 bp, Homo sapiens
  misc_feature: HIJSMM301AOCQJ.51.87.H10.1.454.light.4.raw
cgatcgtatacacgaccggtgctcgatttagcagtactgcgttgggtttgggggggagcctagctgtgctgtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagccc

SEQ ID NO: 592259 - DNA, 500 bp, Homo sapiens
  misc_feature: HIJSMM301CZRZ4.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacgactgaccgtcctaggtcagcccaaggctgccccctcggtcactctgttcccgccctcctccacctactatg

SEQ ID NO: 592260 - DNA, 494 bp, Homo sapiens; identical to SEQ ID NO: 534992
  misc_feature: HIJSMM301DDNJY.9.1.A01.1.454.light.4.raw

SEQ ID NO: 592261 - DNA, 484 bp, Homo sapiens
  misc_feature: HIJSMM301AJWRC.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattaactgtcaacagtatgataatctccctcccactttcggcggagggaccaaggtggagatcaaacgaactgtggctgcaccat

SEQ ID NO: 592262 - DNA, 486 bp, Homo sapiens
  misc_feature: HIJSMM301EFR2M.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattatgtcaatcagcagacaacagtaatacttatctttatgtcttcggatctgggaccagggtcaccgtcctaggtcagcccaaggccaacccca

SEQ ID NO: 592263 - DNA, 505 bp, Homo sapiens
  misc_feature: HIJSMM301CZNT9.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcacc

SEQ ID NO: 592264 - DNA, 494 bp, Homo sapiens; identical to SEQ ID NO: 534994
  misc_feature: HIJSMM301D8629.27.78.H01.1.454.light.4.raw

SEQ ID NO: 592265 - DNA, 503 bp, Homo sapiens; identical to SEQ ID NO: 537189
  misc_feature: HIJSMM301A715Q.19.85.H08.1.454.light.4.raw

SEQ ID NO: 592266 - DNA, 479 bp, Homo sapiens
  misc_feature: HIJSMM301ECAIV.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcgggac

SEQ ID NO: 592267 - DNA, 494 bp, Homo sapiens; identical to SEQ ID NO: 534992
  misc_feature: HIJSMM301BR4XR.9.1.A01.1.454.light.4.raw

SEQ ID NO: 592268 - DNA, 494 bp, Homo sapiens
  misc_feature: HIJSMM301B9PL3.49.69.G03.1.454.light.4.raw
agtcgagagacacgaccggtgctcgatttagtcgctgcgtaaaggagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatt

SEQ ID NO: 592269 - DNA, 444 bp, Homo sapiens; identical to SEQ ID NO: 535192
  misc_feature: HIJSMM301EWH5S.5.9.A09.1.454.light.4.raw

SEQ ID NO: 592270 - DNA, 513 bp, Homo sapiens
  misc_feature: HIJSMM301C4USF.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtggggggttcaatattggaggtaacaatgtgcactggtaccagcagaaggcagggcaggcccctgtactggtcatctagtgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctggaccaaggtcaccgtcctaggtcagcccaaggccaacccactgtcactctgttcccaccctcctcga

SEQ ID NO: 592271 - DNA, 490 bp, Homo sapiens; identical to SEQ ID NO: 542820
  misc_feature: HIJSMM301B39AO.11.12.B01.1.454.light.4.raw

SEQ ID NO: 592272 - DNA, 499 bp, Homo sapiens
  misc_feature: HIJSMM301CD4BA.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctacaccatctgtcttcatcttcccgccta

SEQ ID NO: 592273 - DNA, 504 bp, Homo sapiens; identical to SEQ ID NO: 558952
  misc_feature: HIJSMM301EP0OO.22.15.B04.1.454.light.4.raw

SEQ ID NO: 592274 - DNA, 503 bp, Homo sapiens; identical to SEQ ID NO: 538884
  misc_feature: HIJSMM301CS9W7.27.78.H01.1.454.light.4.raw

SEQ ID NO: 592275 - DNA, 469 bp, Homo sapiens; identical to SEQ ID NO: 574009
  misc_feature: HIJSMM301B4AHX.49.75.G09.1.454.light.4.raw

SEQ ID NO: 592276 - DNA, 486 bp, Homo sapiens; identical to SEQ ID NO: 535043
  misc_feature: HIJSMM301CQE2W.46.35.D02.1.454.light.4.raw

SEQ ID NO: 592277 - DNA, 400 bp, Homo sapiens
  misc_feature: HIJSMM301CYSIL.8.53.E09.1.454.light.4.raw
ctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 592278 - DNA, 513 bp, Homo sapiens
  misc_feature: HIJSMM301DZR1C.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 592279 - DNA, 492 bp, Homo sapiens; identical to SEQ ID NO: 537395
  misc_feature: HIJSMM301EAKIS.16.73.G07.1.454.light.4.raw

SEQ ID NO: 592280 - DNA, 520 bp, Homo sapiens; identical to SEQ ID NO: 539176
  misc_feature: HIJSMM301ENQAD.27.23.C01.1.454.light.4.raw

SEQ ID NO: 592281 - DNA, 508 bp, Homo sapiens
  misc_feature: HIJSMM301D2HHO.3.79.H02.1.454.light.4.raw
agacgcactccacgaccggtgctcgatttagtgtcacacgaagggaaaggggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtacctaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 592282 - DNA, 488 bp, Homo sapiens; identical to SEQ ID NO: 537260
  misc_feature: HIJSMM301BMAA2.47.70.G04.1.454.light.4.raw

SEQ ID NO: 592283 - DNA, 476 bp, Homo sapiens; identical to SEQ ID NO: 537812
  misc_feature: HIJSMM301E0DL4.3.82.H05.1.454.light.4.raw

SEQ ID NO: 592284 - DNA, 485 bp, Homo sapiens
  misc_feature: HIJSMM301CZNWW.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggccgaagggaccgaacggtggagaacg

SEQ ID NO: 592285 - DNA, 509 bp, Homo sapiens; identical to SEQ ID NO: 551627
  misc_feature: HIJSMM301BUA44.11.57.F02.1.454.light.4.raw

SEQ ID NO: 592286 - DNA, 510 bp, Homo sapiens
  misc_feature: HIJSMM301CM8JB.52.41.D08.1.454.light.4.raw
cgcagtacgacacgaccggtgctcgatttagtcacgcgagaaagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaacatcggagggaatactgtgaactggtaccagcaactcccagggacggcccccagactcctcatctttagtcataatcagcggccctcaggggtccctgaccgattctctggctccaagtctggcacctcagcctccttggccatcagtgggctccagtctgacgatgaggctgattacttctgtgcaacttgggatgacagcctgaatggtccggtgttcggcggagggaccaagcttacgttctgggtcagcccaaggctgtcccccg

SEQ ID NO: 592287 - DNA, 513 bp, Homo sapiens; identical to SEQ ID NO: 555865
  misc_feature: HIJSMM301CZKG5.47.23.C01.1.454.light.4.raw

SEQ ID NO: 592288 - DNA, 515 bp, Homo sapiens
  misc_feature: HIJSMM301D95GU.43.19.B08.1.454.light.4.raw
tgtgagtagtcacgaccggtgctcgatttagtgagtcagtaagggggggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcctcactact

SEQ ID NO: 592289 - DNA, 480 bp, Homo sapiens; identical to SEQ ID NO: 535291
  misc_feature: HIJSMM301C5PLF.22.59.F04.1.454.light.4.raw

SEQ ID NO: 592290 - DNA, 497 bp, Homo sapiens; identical to SEQ ID NO: 551301
  misc_feature: HIJSMM301D7EGG.15.81.H04.1.454.light.4.raw

SEQ ID NO: 592291 - DNA, 435 bp, Homo sapiens
  misc_feature: HIJSMM301DQJ98.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttcccgccatcctgacatactcgta

SEQ ID NO: 592292 - DNA, 510 bp, Homo sapiens
  misc_feature: HIJSMM301AMQK5.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcgagggaccaagctgaccgtcctaggtcagcccaaggctgccccctggtccactctgttcccg

SEQ ID NO: 592293 - DNA, 492 bp, Homo sapiens; identical to SEQ ID NO: 573597
  misc_feature: HIJSMM301EKCG4.10.72.G06.1.454.light.4.raw

SEQ ID NO: 592294 - DNA, 500 bp, Homo sapiens; identical to SEQ ID NO: 568876
  misc_feature: HIJSMM301DOL5O.52.53.E09.1.454.light.4.raw

SEQ ID NO: 592295 - DNA, 483 bp, Homo sapiens
  misc_feature: HIJSMM301ENNT1.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctctcaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtgctgcacc

SEQ ID NO: 592296 - DNA, 470 bp, Homo sapiens; identical to SEQ ID NO: 535302
  misc_feature: HIJSMM301AJ9C9.13.76.G10.1.454.light.4.raw

SEQ ID NO: 592297 - DNA, 489 bp, Homo sapiens; identical to SEQ ID NO: 535139
  misc_feature: HIJSMM301B3PTP.14.55.E11.1.454.light.4.raw

SEQ ID NO: 592298 - DNA, 502 bp, Homo sapiens
  misc_feature: HIJSMM301B78HV.48.23.C01.1.454.light.4.raw
agtatacatacacgaccggtgctcgatttagtacacgtgattagggattggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgtccccccg

SEQ ID NO: 592299 - DNA, 501 bp, Homo sapiens
  misc_feature: HIJSMM301ANGIA.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacgacctccctgaccgtctctgggctccagactgaggatgaggctgactattactgcagctcatttgcaggcagccgtatactcttcggcggagggaccaagctgaccgtcctaggtcagcccaaggctgccccctc

SEQ ID NO: 592300 - DNA, 500 bp, Homo sapiens
  misc_feature: HIJSMM301DJ3CJ.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcactttcggcgggggaccaaggtggagttcaaacgaactgtggctgcaccatctgtcttcatcttcccg

SEQ ID NO: 592301 - DNA, 496 bp, Homo sapiens; identical to SEQ ID NO: 540261
  misc_feature: HIJSMM301EWO5Q.3.78.H01.1.454.light.4.raw

SEQ ID NO: 592302 - DNA, 444 bp, Homo sapiens; identical to SEQ ID NO: 535027
  misc_feature: HIJSMM301DRB4I.8.73.G07.1.454.light.4.raw

SEQ ID NO: 592303 - DNA, 499 bp, Homo sapiens
  misc_feature: HIJSMM301E4APO.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcaggaccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctccactttcggcggagggaccaaggtggagatcaagcgaactgtggctgcaccatctgtcttcatccttcccgcca

SEQ ID NO: 592304 - DNA, 509 bp, Homo sapiens; identical to SEQ ID NO: 583983
  misc_feature: HIJSMM301D00AT.12.48.E04.1.454.light.4.raw

SEQ ID NO: 592305 - DNA, 503 bp, Homo sapiens
  misc_feature: HIJSMM301C3PMY.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcatcgtcctaggtcagcccaaggcccaaccccactgtcactcttccg

SEQ ID NO: 592306 - DNA, 514 bp, Homo sapiens
  misc_feature: HIJSMM301C4AY6.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcttgccccctcggtcactctgttcccgccctcct

SEQ ID NO: 592307 - DNA, 510 bp, Homo sapiens
  misc_feature: HIJSMM301EKJS3.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaaacagttttcncgggcgttcggtccaacgggaccgaaaggtggaaagtcaaaacgaactagtggctgcaccaatctgtcttcatcttccccg

SEQ ID NO: 592308 - DNA, 517 bp, Homo sapiens
  misc_feature: HIJSMM301B63BB.8.43.D10.1.454.light.4.raw
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctcgttcccgccctcctcgacacgcg

SEQ ID NO: 592309 - DNA, 486 bp, Homo sapiens; identical to SEQ ID NO: 535043
  misc_feature: HIJSMM301A5KHM.46.35.D02.1.454.light.4.raw

SEQ ID NO: 592310 - DNA, 502 bp, Homo sapiens
  misc_feature: HIJSMM301E3E4V.48.53.E09.1.454.light.4.raw
agtatacatacacgaccggtgctcgatttagagagagtgtgttgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaagggtggacatcaaacgaactgtggctgcaccatctgtcttcatcttcccg

SEQ ID NO: 592311 - DNA, 464 bp, Homo sapiens; identical to SEQ ID NO: 536640
  misc_feature: HIJSMM301BW30V.26.78.H01.1.454.light.4.raw

SEQ ID NO: 592312 - DNA, 521 bp, Homo sapiens; identical to SEQ ID NO: 536990
  misc_feature: HIJSMM301ATRNA.27.23.C01.1.454.light.4.raw
  modified_base (517)..(517): a, c, t, g, unknown or other

SEQ ID NO: 592313 - DNA, 480 bp, Homo sapiens
  misc_feature: HIJSMM301ASDUJ.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagccccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaaacgaactgtggctgcacc

SEQ ID NO: 592314 - DNA, 514 bp, Homo sapiens; identical to SEQ ID NO: 538541
  misc_feature: HIJSMM301DKOS9.47.23.C01.1.454.light.4.raw

SEQ ID NO: 592315 - DNA, 484 bp, Homo sapiens; identical to SEQ ID NO: 535441
  misc_feature: HIJSMM301EIR5T.26.60.F05.1.454.light.4.raw

SEQ ID NO: 592316 - DNA, 447 bp, Homo sapiens; identical to SEQ ID NO: 535020
  misc_feature: HIJSMM301BSDZI.18.9.A09.1.454.light.4.raw

SEQ ID NO: 592317 - DNA, 482 bp, Homo sapiens; identical to SEQ ID NO: 579164
  misc_feature: HIJSMM301C30SR.13.6.A06.1.454.light.4.raw

SEQ ID NO: 592318 - DNA, 486 bp, Homo sapiens; identical to SEQ ID NO: 537238
  misc_feature: HIJSMM301A47TP.19.71.G05.1.454.light.4.raw

SEQ ID NO: 592319 - DNA, 496 bp, Homo sapiens
  misc_feature: HIJSMM301CEE9P.11.59.F04.1.454.light.4.raw
  modified_base (463)..(463): a, c, t, g, unknown or other
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccntgtcattctgttcccacctcctcgtatctctcg

SEQ ID NO: 592320 - DNA, 474 bp, Homo sapiens
  misc_feature: HIJSMM301D1N18.43.76.G10.1.454.light.4.raw
tgtgagtagtcacgaccggtgctcgatttagtcactcatacaggggactgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggttttcggcggagggacaagctgaccgtcct

SEQ ID NO: 592321 - DNA, 509 bp, Homo sapiens
  misc_feature: HIJSMM301A11GK.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccgaaggtggaagtcaagcgaactgtggctgcaccatctgtcttcatccttccgcat

SEQ ID NO: 592322 - DNA, 494 bp, Homo sapiens; identical to SEQ ID NO: 535828
  misc_feature: HIJSMM301CLMTA.3.36.D03.1.454.light.4.raw

SEQ ID NO: 592323 - DNA, 485 bp, Homo sapiens; identical to SEQ ID NO: 546918
  misc_feature: HIJSMM301EJQ8L.51.3.A03.1.454.light.4.raw

SEQ ID NO: 592324 - DNA, 480 bp, Homo sapiens; identical to SEQ ID NO: 535630
  misc_feature: HIJSMM301EOUEF.40.59.F04.1.454.light.4.raw

SEQ ID NO: 592325 - DNA, 475 bp, Homo sapiens; identical to SEQ ID NO: 544617
  misc_feature: HIJSMM301D8WS4.13.76.G10.1.454.light.4.raw

SEQ ID NO: 592326 - DNA, 489 bp, Homo sapiens
  misc_feature: HIJSMM301CYQ7T.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgtaacttactactgtcaacagagttacagtacccccctnactttcggcggagggaccaaggcggagatcagacgaactgtggctgcaccatctgtcttcat

SEQ ID NO: 592327 - DNA, 463 bp, Homo sapiens
  misc_feature: HIJSMM301BDTVY.26.23.C01.1.454.light.4.raw
  modified_base (454)..(454): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggggacggacggnggtaggagt

SEQ ID NO: 592328 - DNA, 506 bp, Homo sapiens; identical to SEQ ID NO: 557726
  misc_feature: HIJSMM301EA05D.47.83.H06.1.454.light.4.raw

SEQ ID NO: 592329 - DNA, 492 bp, Homo sapiens
  misc_feature: HIJSMM301A0EFF.43.33.C11.1.454.light.4.raw
tgtgagtagtcacgaccggtgctcgattttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaagttgaacatcaatcgaactgtggctgcaccatctgtctt

SEQ ID NO: 592330 - DNA, 486 bp, Homo sapiens; identical to SEQ ID NO: 554021
  misc_feature: HIJSMM301B050P.40.83.H06.1.454.light.4.raw

SEQ ID NO: 592331 - DNA, 445 bp, Homo sapiens; identical to SEQ ID NO: 535913
  misc_feature: HIJSMM301CZ28J.5.9.A09.1.454.light.4.raw

SEQ ID NO: 592332 - DNA, 499 bp, Homo sapiens
  misc_feature: HIJSMM301BP1OX.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcgagggaccaagctgaccgtcctgcgtcagcccaaggctgccccctggtcact

SEQ ID NO: 592333 - DNA, 496 bp, Homo sapiens
  misc_feature: HIJSMM301BK9C4.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacagattcttcttaccctcggacgtcgtccgacgggacgacggtcggagtgtctaagacgaacgtagtggtcgtggcaccactcttcg

SEQ ID NO: 592334 - DNA, 510 bp, Homo sapiens
  misc_feature: HIJSMM301CLW9H.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaaggtggaaatacgaaaacgaactagtggctgcaccatctgtcttcactcttccccg

SEQ ID NO: 592335 - DNA, 490 bp, Homo sapiens
  misc_feature: HIJSMM301AO775.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaacggtaggaaatacaaacgaactagtggctgcaccta

SEQ ID NO: 592336 - DNA, 497 bp, Homo sapiens
  misc_feature: HIJSMM301AEITQ.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccgagggtggatatcaaacgaactagtggctgcaccatctgtcttcatt

SEQ ID NO: 592337 - DNA, 482 bp, Homo sapiens
  misc_feature: HIJSMM301CCKDK.5.28.C06.1.454.light.4.raw
  modified_base (398)..(398): a, c, t, g, unknown or other
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtcccaaactcctgatctacgatgcatctaatttggaaataggggtctcatcaaggttcagtgggagtggatctgggacagaattcactttcaccatcagcagcctgcaacctgaagatattgnaacatattactgtcaacagtatgatagtctggccgccttcggcggagggaccgaaggtaggagatacgaacgaactgtggctcg

SEQ ID NO: 592338 - DNA, 494 bp, Homo sapiens; identical to SEQ ID NO: 534992
  misc_feature: HIJSMM301B44G4.9.1.A01.1.454.light.4.raw

SEQ ID NO: 592339 - DNA, 497 bp, Homo sapiens
  misc_feature: HIJSMM301B1ERD.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcgccaagggacacgactggagattaaacgaacgtagtggctgcaccactctgttctt

SEQ ID NO: 592340 - DNA, 505 bp, Homo sapiens; identical to SEQ ID NO: 546412
  misc_feature: HIJSMM301BTJJ1.22.21.B10.1.454.light.4.raw

SEQ ID NO: 592341 - DNA, 492 bp, Homo sapiens; identical to SEQ ID NO: 540973
  misc_feature: HIJSMM301A2ZXM.43.20.B09.1.454.light.4.raw

SEQ ID NO: 592342 - DNA, 493 bp, Homo sapiens; identical to SEQ ID NO: 544335
  misc_feature: HIJSMM301D7I1F.5.57.F02.1.454.light.4.raw

SEQ ID NO: 592343 - DNA, 486 bp, Homo sapiens
  misc_feature: HIJSMM301DGOFQ.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgcagttttattactgtcagcagtatcatgactggccgctcaccttcggccaagggacacgactggagattaaacgaactgtggctgcaccat

SEQ ID NO: 592344 - DNA, 484 bp, Homo sapiens; identical to SEQ ID NO: 535400
  misc_feature: HIJSMM301A02ME.46.26.C04.1.454.light.4.raw

SEQ ID NO: 592345 - DNA, 508 bp, Homo sapiens
  misc_feature: HIJSMM301EYQCE.9.55.E11.1.454.light.4.raw
tgatacgtctcacgaccggtgctcgatttagcactcgcacgttgggtttggggctgggcctaaggaagcagcactggtggtgcctcagccatggtctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaggctgccccctcggtcactctcg

SEQ ID NO: 592346 - DNA, 485 bp, Homo sapiens; identical to SEQ ID NO: 536576
  misc_feature: HIJSMM301DHU2P.46.35.D02.1.454.light.4.raw

SEQ ID NO: 592347 - DNA, 504 bp, Homo sapiens
  misc_feature: HIJSMM301CQ5V2.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcattttatttctgtcagcagtctgaagactggccgttcactttcggcggagggaccaaggtggacctcaaacgaactgtggctgcaccatctgtcttcatcttcccgc

SEQ ID NO: 592348 - DNA, 505 bp, Homo sapiens
  misc_feature: HIJSMM301CRWUS.53.81.H04.1.454.light.4.raw
cgcgtatacacacgaccggtgctcgatttagtagtgtagattcgcggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccattagtggcctccggtccgacgatgaggctgattattattgtgcagcatgggatgacagcctgagtggtgtggtattcggcggagggaccaagctgaccgtcctaggtcagcccaaggctgccccccg

SEQ ID NO: 592349 - DNA, 504 bp, Homo sapiens
  misc_feature: HIJSMM301BE8IM.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagtgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcacgcctccctggccatcagtgggctccgggccgaggatgaggctgattattactgtgcaggatggggatgacaacctgggtgcttatctcttcggacctgggaccaaggtcaccgtcttggt

SEQ ID NO: 592350 - DNA, 477 bp, Homo sapiens
  misc_feature: HIJSMM301BXJCD.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttccgctcaccttcgcggggggaccaaggtggagatcaaacgaactgtggctgcacc

SEQ ID NO: 592351 - DNA, 496 bp, Homo sapiens; identical to SEQ ID NO: 535109
  misc_feature: HIJSMM301AD1TK.16.78.H01.1.454.light.4.raw

SEQ ID NO: 592352 - DNA, 491 bp, Homo sapiens; identical to SEQ ID NO: 545741
  misc_feature: HIJSMM301BOHIG.43.33.C11.1.454.light.4.raw

SEQ ID NO: 592353 - DNA, 510 bp, Homo sapiens
  misc_feature: HIJSMM301BOMF1.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttccccg

SEQ ID NO: 592354 - DNA, 511 bp, Homo sapiens
  misc_feature: HIJSMM301BBTDP.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaacgcggggacccagaccctggacgcctcagttggaagcagccgatccagcctgcggagcctgtgggcaggtcagcccaaggccaacccactcgtcactc

SEQ ID NO: 592355 - DNA, 489 bp, Homo sapiens; identical to SEQ ID NO: 536663
  misc_feature: HIJSMM301D6FZM.16.72.G06.1.454.light.4.raw

SEQ ID NO: 592356 - DNA, 448 bp, Homo sapiens
  misc_feature: HIJSMM301CRBPP.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccccacctcctccatactcgta

SEQ ID NO: 592357 - DNA, 486 bp, Homo sapiens; identical to SEQ ID NO: 535043
  misc_feature: HIJSMM301DR9ZE.46.35.D02.1.454.light.4.raw

SEQ ID NO: 592358 - DNA, 492 bp, Homo sapiens
  misc_feature: HIJSMM301DG3H3.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttatactgtcaacagcgtaccacaggattcactttcggccctgggaccagagtggatatcaaacgaactgtggctgcaccatctgtcttcatcttcccg

SEQ ID NO: 592359 - DNA, 504 bp, Homo sapiens; identical to SEQ ID NO: 552234
  misc_feature: HIJSMM301A5DAW.22.21.B10.1.454.light.4.raw

SEQ ID NO: 592360 - DNA, 475 bp, Homo sapiens
  misc_feature: HIJSMM301BTEM7.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacatcaaacgaact

SEQ ID NO: 592361 - DNA, 495 bp, Homo sapiens
  misc_feature: HIJSMM301BZRY1.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctgccccctcggtcactctgttcccgccctcctcgagtgcgtct

SEQ ID NO: 592362 - DNA, 472 bp, Homo sapiens
  misc_feature: HIJSMM301EA0K7.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctcgaccatcacgcgggacccaggctatggatgaggctgactattactgtcaggcgtgggacagcagcactgcccgctatgtcttcggaactgggaccaaggtcaccgtcctaagtcag

SEQ ID NO: 592363 - DNA, 477 bp, Homo sapiens; identical to SEQ ID NO: 539715
  misc_feature: HIJSMM301B8K5X.48.51.E07.1.454.light.4.raw

SEQ ID NO: 592364 - DNA, 500 bp, Homo sapiens; identical to SEQ ID NO: 586195
  misc_feature: HIJSMM301A08B9.41.18.B07.1.454.light.4.raw

SEQ ID NO: 592365 - DNA, 485 bp, Homo sapiens; identical to SEQ ID NO: 535985
  misc_feature: HIJSMM301D0VSD.15.1.A01.1.454.light.4.raw

SEQ ID NO: 592366 - DNA, 503 bp, Homo sapiens
  misc_feature: HIJSMM301D9RU4.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccggcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtggatgacatcctgaatggtccggtgttcggcggagggaccaggctgaccgtcctaagtcagcccaaggcctg

SEQ ID NO: 592367 - DNA, 497 bp, Homo sapiens
  misc_feature: HIJSMM301C8YJC.2.34.D01.1.454.light.4.raw
acgctcgacacacgaccggtgctcgatttagatcgtctgtgttgggtttgggggtctcaggaggcagcgctctcaggacgtcaccaccatggcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctc

SEQ ID NO: 592368 - DNA, 511 bp, Homo sapiens
  misc_feature: HIJSMM301AUIOX.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttcccta

SEQ ID NO: 592369 - DNA, 494 bp, Homo sapiens; identical to SEQ ID NO: 534994
  misc_feature: HIJSMM301CZYRV.27.78.H01.1.454.light.4.raw

SEQ ID NO: 592370 - DNA, 444 bp, Homo sapiens; identical to SEQ ID NO: 535192
  misc_feature: HIJSMM301CM2VJ.5.9.A09.1.454.light.4.raw

SEQ ID NO: 592371 - DNA, 454 bp, Homo sapiens; identical to SEQ ID NO: 534964
  misc_feature: HIJSMM301CKU9H.19.86.H09.1.454.light.4.raw

SEQ ID NO: 592372 - DNA, 497 bp, Homo sapiens; identical to SEQ ID NO: 535664
  misc_feature: HIJSMM301CH20Z.22.14.B03.1.454.light.4.raw

SEQ ID NO: 592373 - DNA, 502 bp, Homo sapiens
  misc_feature: HIJSMM301BGUBK.40.45.E01.1.454.light.4.raw
tctagcgactcacgaccggtgctcgatttagtgagtcagtaagggaaaggggggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagattttgcagtttattactgtcagcagcgtgccaactggcctctcactttcggcggagggaccaaggtggagatcaaacgaactgtggctgcaccatctgtcttcatcttcccgcc

SEQ ID NO: 592374 - DNA, 499 bp, Homo sapiens
  misc_feature: HIJSMM301DQEIQ.48.31.C09.1.454.light.4.raw
agtatacatacacgaccggtgctcgatttagacgtctcatcaaggaaggaagggggcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcgccaaggaccaaggtggaagtcagacgaactgtggctgcaccatctgtcttcatcttccccg

SEQ ID NO: 592375 - DNA, 503 bp, Homo sapiens
  misc_feature: HIJSMM301BZGDE.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccaccct

SEQ ID NO: 592376 - DNA, 504 bp, Homo sapiens
  misc_feature: HIJSMM301AIP3M.51.23.C01.1.454.light.4.raw
cgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggccagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 592377 - DNA, 500 bp, Homo sapiens
  misc_feature: HIJSMM301CLFVB.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgggcgggggaccaaggctgaccgtcctaggtcagcccaaggct

SEQ ID NO: 592378 - DNA, 502 bp, Homo sapiens
  misc_feature: HIJSMM301ETHYQ.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccgccctcctcta

SEQ ID NO: 592379 - DNA, 481 bp, Homo sapiens; identical to SEQ ID NO: 584658
  misc_feature: HIJSMM301E0P8Z.43.87.H10.1.454.light.4.raw

SEQ ID NO: 592380 - DNA, 515 bp, Homo sapiens; identical to SEQ ID NO: 556262
  misc_feature: HIJSMM301AIFGU.40.27.C05.1.454.light.4.raw

SEQ ID NO: 592381 - DNA, 472 bp, Homo sapiens; identical to SEQ ID NO: 536302
  misc_feature: HIJSMM301DP9AN.18.76.G10.1.454.light.4.raw

SEQ ID NO: 592382 - DNA, 482 bp, Homo sapiens; identical to SEQ ID NO: 536622
  misc_feature: HIJSMM301DSANN.7.85.H08.1.454.light.4.raw

SEQ ID NO: 592383 - DNA, 489 bp, Homo sapiens; identical to SEQ ID NO: 536663
  misc_feature: HIJSMM301D7Z1K.16.72.G06.1.454.light.4.raw

SEQ ID NO: 592384 - DNA, 447 bp, Homo sapiens; identical to SEQ ID NO: 535201
  misc_feature: HIJSMM301CCSS5.18.9.A09.1.454.light.4.raw

SEQ ID NO: 592385 - DNA, 513 bp, Homo sapiens; identical to SEQ ID NO: 540112
  misc_feature: HIJSMM301CQXWD.17.62.F07.1.454.light.4.raw

SEQ ID NO: 592386 - DNA, 487 bp, Homo sapiens
  misc_feature: HIJSMM301EZGST.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgagggaccaaggcggagatcagacgaactgtggctgcaccatctgtctcta

SEQ ID NO: 592387 - DNA, 509 bp, Homo sapiens; identical to SEQ ID NO: 541829
  misc_feature: HIJSMM301EABHX.17.28.C06.1.454.light.4.raw

SEQ ID NO: 592388 - DNA, 515 bp, Homo sapiens; identical to SEQ ID NO: 541898
  misc_feature: HIJSMM301AZPA4.16.66.F11.1.454.light.4.raw

SEQ ID NO: 592389 - DNA, 480 bp, Homo sapiens; identical to SEQ ID NO: 553480
  misc_feature: HIJSMM301C3IZA.21.25.C03.1.454.light.4.raw

SEQ ID NO: 592390 - DNA, 488 bp, Homo sapiens
  misc_feature: HIJSMM301DL5Q1.52.33.C11.1.454.light.4.raw
cgcagtacgacacgaccggtgctcgatttagagtgagctcgttgggtttgggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaaccgtcctaggtcagcccaaggcc

SEQ ID NO: 592391 - DNA, 444 bp, Homo sapiens; identical to SEQ ID NO: 535192
  misc_feature: HIJSMM301APAIO.5.9.A09.1.454.light.4.raw

SEQ ID NO: 592392 - DNA, 475 bp, Homo sapiens
  misc_feature: HIJSMM301BPJF4.5.53.E09.1.454.light.4.raw
atcagacacgcacgaccggtgctcgatttagagagagtgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaacggacgacgactggagaattaaacgaa

SEQ ID NO: 592393 - DNA, 495 bp, Homo sapiens; identical to SEQ ID NO: 535486
  misc_feature: HIJSMM301ETACA.26.72.G06.1.454.light.4.raw

SEQ ID NO: 592394 - DNA, 503 bp, Homo sapiens
  misc_feature: HIJSMM301C0JDZ.41.37.D04.1.454.light.4.raw
tctatactatcacgaccggtgctcgatttagtagcatactgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 592395 - DNA, 509 bp, Homo sapiens; identical to SEQ ID NO: 541829
  misc_feature: HIJSMM301EPH58.17.28.C06.1.454.light.4.raw

SEQ ID NO: 592396 - DNA, 495 bp, Homo sapiens
  misc_feature: HIJSMM301CFZTD.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattaagaacttatttaaattggtatcaacagaaaccagggaaacgcccctgacctcctgatctatgctgcatccagtttgcacagtggggtcccgtcaaggttcagtggcagtggatcgtgggacagatttcactctcaccgtcagcagtctgcaacctgaagtattttgctaacttactactgtcaacagagttacacgtacccccctcacctttcggcggagggaccaaggcggagatcagacgaactgtgctgcacatctgtcttcta

SEQ ID NO: 592397 - DNA, 488 bp, Homo sapiens
  misc_feature: HIJSMM301B6BO4.46.26.C04.1.454.light.4.raw
actagcagtacacgaccggtgctcgatttagtctagcgactttgggtttggggtgatcaggactcctcagttcaccttctcacaatgaggttccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccgaaggtggaggatcaaacgaact

SEQ ID NO: 592398 - DNA, 494 bp, Homo sapiens
  misc_feature: HIJSMM301C1O92.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcact

SEQ ID NO: 592399 - DNA, 485 bp, Homo sapiens; identical to SEQ ID NO: 536576
  misc_feature: HIJSMM301D83TW.46.35.D02.1.454.light.4.raw

SEQ ID NO: 592400 - DNA, 486 bp, Homo sapiens; identical to SEQ ID NO: 572575
  misc_feature: HIJSMM301DQ3GC.41.44.D11.1.454.light.4.raw

SEQ ID NO: 592401 - DNA, 498 bp, Homo sapiens; identical to SEQ ID NO: 536879
  misc_feature: HIJSMM301EPEEQ.22.14.B03.1.454.light.4.raw

SEQ ID NO: 592402 - DNA, 493 bp, Homo sapiens; identical to SEQ ID NO: 590681
  misc_feature: HIJSMM301DRY9O.18.11.A11.1.454.light.4.raw

SEQ ID NO: 592403 - DNA, 483 bp, Homo sapiens
  misc_feature: HIJSMM301DD9WR.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtgcccgctcattttcggcggagggaccaaggtgcagatcaaacgaactgtggctgca

SEQ ID NO: 592404 - DNA, 494 bp, Homo sapiens
  misc_feature: HIJSMM301EY2B0.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggactagtggctgcaccatctgtcttcatcttccccg

SEQ ID NO: 592405 - DNA, 488 bp, Homo sapiens; identical to SEQ ID NO: 543314
  misc_feature: HIJSMM301EU4C1.3.33.C11.1.454.light.4.raw

SEQ ID NO: 592406 - DNA, 476 bp, Homo sapiens
  misc_feature: HIJSMM301C4BHF.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggcggtagggaccaaggtggagatcaaacgaacctgt

SEQ ID NO: 592407 - DNA, 511 bp, Homo sapiens; identical to SEQ ID NO: 541549
  misc_feature: HIJSMM301AVDBO.40.33.C11.1.454.light.4.raw

SEQ ID NO: 592408 - DNA, 511 bp, Homo sapiens
  misc_feature: HIJSMM301CLYCE.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcgctacg

SEQ ID NO: 592409 - DNA, 503 bp, Homo sapiens
  misc_feature: HIJSMM301DBIQB.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttctcaccctcctccgt

SEQ ID NO: 592410 - DNA, 496 bp, Homo sapiens; identical to SEQ ID NO: 542375
  misc_feature: HIJSMM301CYJZG.7.59.F04.1.454.light.4.raw

SEQ ID NO: 592411 - DNA, 496 bp, Homo sapiens; identical to SEQ ID NO: 566794
  misc_feature: HIJSMM301AH105.47.64.F09.1.454.light.4.raw

SEQ ID NO: 592412 - DNA, 495 bp, Homo sapiens
  misc_feature: HIJSMM301EHBV9.4.61.F06.1.454.light.4.raw
agcactgtagcacgaccggtgctcgatttagctacgctctaagggaaagggggaagacaatgggtttgatttagatcacagaggtgagtttaatgttttacttctgttctcagatgccgccggagaagttgtgctgacgcagtctccaggcaccctgtctttgtctccaggggagagcgccaccctctcctgcaggcccagtgaggcgataaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtattttgtcagcagtatggcacatcaccggtcaccttcggccaagggtcacggctggagattaaacgaactgtggctgcaccatctgtcttcatcttcccgccatctgactac

SEQ ID NO: 592413 - DNA, 460 bp, Homo sapiens
  misc_feature: HIJSMM301DUTZ2.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctccgctcactttcggcggagggaccaaggtggagatcaaacgaa

SEQ ID NO: 592414 - DNA, 490 bp, Homo sapiens; identical to SEQ ID NO: 535526
  misc_feature: HIJSMM301ECIS8.26.78.H01.1.454.light.4.raw

SEQ ID NO: 592415 - DNA, 422 bp, Homo sapiens; identical to SEQ ID NO: 539618
  misc_feature: HIJSMM301DAOPX.41.14.B03.1.454.light.4.raw

SEQ ID NO: 592416 - DNA, 523 bp, Homo sapiens
  misc_feature: HIJSMM301B8IY2.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcgccgaagggaccgaacggtaggaaggtacgaaacgaacgtagtaggtcgtggcaccactactcgtcttctctcttcccgtccact

SEQ ID NO: 592417 - DNA, 498 bp, Homo sapiens
  misc_feature: HIJSMM301ALOYU.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtccggttgcacagtggcgtcccacggaagattcagcggcggtggatctagggcagatttcactctcaccatcaatcacctgcaggctgaggattttgtcaacttactactgtcagcaggctaacaggctgcccccaacccttcggccacggggacgacgactggaggattaaacgaaactagtggcgtgcaccactactcgttc

SEQ ID NO: 592418 - DNA, 508 bp, Homo sapiens
  misc_feature: HIJSMM301BEXL3.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacgccttggacgtaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtggatagtagtagtgatcattatgtcttcggatctgggaccagggtcaccgtcctaggtcagcccaaggccaaccccactgtcactctgttcccacct

SEQ ID NO: 592419 - DNA, 517 bp, Homo sapiens
  misc_feature: HIJSMM301BB6KA.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactcttcg

SEQ ID NO: 592420 - DNA, 481 bp, Homo sapiens; identical to SEQ ID NO: 582228
  misc_feature: HIJSMM301EJB5S.11.76.G10.1.454.light.4.raw

SEQ ID NO: 592421 - DNA, 496 bp, Homo sapiens; identical to SEQ ID NO: 535423
  misc_feature: HIJSMM301CF9SE.3.33.C11.1.454.light.4.raw

SEQ ID NO: 592422 - DNA, 491 bp, Homo sapiens; identical to SEQ ID NO: 535194
  misc_feature: HIJSMM301EC879.26.78.H01.1.454.light.4.raw

SEQ ID NO: 592423 - DNA, 498 bp, Homo sapiens; identical to SEQ ID NO: 544837
  misc_feature: HIJSMM301CMP99.11.71.G05.1.454.light.4.raw

SEQ ID NO: 592424 - DNA, 491 bp, Homo sapiens; identical to SEQ ID NO: 535294
  misc_feature: HIJSMM301A24VM.16.68.G02.1.454.light.4.raw

SEQ ID NO: 592425 - DNA, 454 bp, Homo sapiens; identical to SEQ ID NO: 536347
  misc_feature: HIJSMM301CAWUX.19.86.H09.1.454.light.4.raw

SEQ ID NO: 592426 - DNA, 510 bp, Homo sapiens
  misc_feature: HIJSMM301ANP0X.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcaggacgaaggtaggagtacaacgaactagtggcgtgtcgaccactctcgtcttcactcttcccgtcccact

SEQ ID NO: 592427 - DNA, 511 bp, Homo sapiens; identical to SEQ ID NO: 548439
  misc_feature: HIJSMM301AVX31.16.46.E02.1.454.light.4.raw

SEQ ID NO: 592428 - DNA, 511 bp, Homo sapiens
  misc_feature: HIJSMM301DOBRG.7.34.D01.1.454.light.4.raw
cgtgtctctacacgaccggtgctcgatttagatcgtctgtgttgggtttgggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaaagctgaccgtcctgcgtcagcccaaggctgccccctcggtcact

SEQ ID NO: 592429 - DNA, 515 bp, Homo sapiens
  misc_feature: HIJSMM301A85IV.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcacacggcctccctgaccatctctgggctccaggctgaagatcaggctgattattactgctgttctattttctaagttttccttttttgttctttcggaacgtgggaccggaggtctaccgtcctaggtcacgcccaacggccaaccccactcg

SEQ ID NO: 592430 - DNA, 487 bp, Homo sapiens; identical to SEQ ID NO: 536206
  misc_feature: HIJSMM301C1V73.47.38.D05.1.454.light.4.raw

SEQ ID NO: 592431 - DNA, 486 bp, Homo sapiens
  misc_feature: HIJSMM301EV15O.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagaattaaacgaactgtggctgcaccat

SEQ ID NO: 592432 - DNA, 502 bp, Homo sapiens; identical to SEQ ID NO: 541345
  misc_feature: HIJSMM301ELSAQ.21.22.B11.1.454.light.4.raw
  modified_base (429)..(429): a, c, t, g, unknown or other

SEQ ID NO: 592433 - DNA, 484 bp, Homo sapiens; identical to SEQ ID NO: 535240
  misc_feature: HIJSMM301DXDM9.47.60.F05.1.454.light.4.raw

SEQ ID NO: 592434 - DNA, 486 bp, Homo sapiens; identical to SEQ ID NO: 535043
  misc_feature: HIJSMM301BTM5E.46.35.D02.1.454.light.4.raw

SEQ ID NO: 592435 - DNA, 486 bp, Homo sapiens; identical to SEQ ID NO: 536323
  misc_feature: HIJSMM301BIOWW.10.2.A02.1.454.light.4.raw

SEQ ID NO: 592436 - DNA, 485 bp, Homo sapiens
  misc_feature: HIJSMM301CCJD7.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggaggatcaaacg

SEQ ID NO: 592437 - DNA, 489 bp, Homo sapiens; identical to SEQ ID NO: 535139
  misc_feature: HIJSMM301C8OGK.14.55.E11.1.454.light.4.raw

SEQ ID NO: 592438 - DNA, 494 bp, Homo sapiens; identical to SEQ ID NO: 534992
  misc_feature: HIJSMM301DY8RU.9.1.A01.1.454.light.4.raw

SEQ ID NO: 592439 - DNA, 485 bp, Homo sapiens
  misc_feature: HIJSMM301BZ5R4.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtctac

SEQ ID NO: 592440 - DNA, 506 bp, Homo sapiens; identical to SEQ ID NO: 570478
  misc_feature: HIJSMM301CI6MH.22.21.B10.1.454.light.4.raw

SEQ ID NO: 592441 - DNA, 532 bp, Homo sapiens
  misc_feature: HIJSMM301BHGLH.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatcgtccgggctccagcctgaggacgaggctgattattattgtagttcatatacaaccagtgacacgttgggtgttcgggcggagggaccgaggctggaccgtcctaggtcacgacccaaggctcgccccctcggtcactcttcgtccccgccct

SEQ ID NO: 592442 - DNA, 498 bp, Homo sapiens
  misc_feature: HIJSMM301CTBC8.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctcgggtcagcccaaggccaaccccactgtcactt

SEQ ID NO: 592443 - DNA, 489 bp, Homo sapiens; identical to SEQ ID NO: 569832
  misc_feature: HIJSMM301CN0UG.16.68.G02.1.454.light.4.raw

SEQ ID NO: 592444 - DNA, 490 bp, Homo sapiens
  misc_feature: HIJSMM301EOBKF.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacatcaagcgaactagtggctgcaccat

SEQ ID NO: 592445 - DNA, 485 bp, Homo sapiens; identical to SEQ ID NO: 542258
  misc_feature: HIJSMM301BA8AZ.10.48.E04.1.454.light.4.raw

SEQ ID NO: 592446 - DNA, 486 bp, Homo sapiens; identical to SEQ ID NO: 538674
  misc_feature: HIJSMM301B5AIK.47.38.D05.1.454.light.4.raw

SEQ ID NO: 592447 - DNA, 508 bp, Homo sapiens
  misc_feature: HIJSMM301C9ANK.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtctacgtcagcccaaggctgccccctcggtcactctcg

SEQ ID NO: 592448 - DNA, 512 bp, Homo sapiens
  misc_feature: HIJSMM301C4QWT.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatacaaacgaaacctgtggctgcaccatcctgtctt

SEQ ID NO: 592449 - DNA, 488 bp, Homo sapiens
  misc_feature: HIJSMM301D8WPS.49.20.B09.1.454.light.4.raw
agtcgagagacacgaccggtgctcgatttagtgtagtgtgaagggcttgatgccttggggtgggaggagagacccctcccctgggatcctgcagctctagtctcccgtggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttt

SEQ ID NO: 592450 - DNA, 484 bp, Homo sapiens; identical to SEQ ID NO: 567965
  misc_feature: HIJSMM301BINH1.48.77.G11.1.454.light.4.raw

SEQ ID NO: 592451 - DNA, 470 bp, Homo sapiens; identical to SEQ ID NO: 536130
  misc_feature: HIJSMM301CCQ8K.7.81.H04.1.454.light.4.raw

SEQ ID NO: 592452 - DNA, 510 bp, Homo sapiens
  misc_feature: HIJSMM301A4VCW.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcgggcggagggaccaaggtcgaccgtcctagggtcagcccaaggcctcgtccccccg

SEQ ID NO: 592453 - DNA, 503 bp, Homo sapiens; identical to SEQ ID NO: 568855
  misc_feature: HIJSMM301C5T69.9.71.G05.1.454.light.4.raw

SEQ ID NO: 592454 - DNA, 487 bp, Homo sapiens; identical to SEQ ID NO: 562900
  misc_feature: HIJSMM301BOPO0.46.35.D02.1.454.light.4.raw

SEQ ID NO: 592455 - DNA, 504 bp, Homo sapiens; identical to SEQ ID NO: 540538
  misc_feature: HIJSMM301A7QPZ.7.71.G05.1.454.light.4.raw

SEQ ID NO: 592456 - DNA, 497 bp, Homo sapiens
  misc_feature: HIJSMM301BBMXY.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtcgtgggacagatttcactctcaccatcagcagcctgcaggctgaagatgtggctagtttattactgtcagcaatattatagtactcctccgaggctcactttcggcggagggaccaaggtggagatacaaacgaact

SEQ ID NO: 592457 - DNA, 494 bp, Homo sapiens
  misc_feature: HIJSMM301C1S30.16.6.A06.1.454.light.4.raw
  modified_base (395)..(395): a, c, t, g, unknown or other
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttnaagatgtggcagtttattactgtcagcagtattatactacttctctgacgttcggccaagggaccaaggtggagatcaaacgaactgtggctgcaccat

SEQ ID NO: 592458 - DNA, 467 bp, Homo sapiens; identical to SEQ ID NO: 560656
  misc_feature: HIJSMM301EUY1W.11.70.G04.1.454.light.4.raw

SEQ ID NO: 592459 - DNA, 489 bp, Homo sapiens
  misc_feature: HIJSMM301CJ4XA.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtacagttttggcctaggggaccaagctggagatcaaacgaactgtggc

SEQ ID NO: 592460 - DNA, 507 bp, Homo sapiens; identical to SEQ ID NO: 542621
  misc_feature: HIJSMM301B3M2I.4.10.A10.1.454.light.4.raw

SEQ ID NO: 592461 - DNA, 480 bp, Homo sapiens; identical to SEQ ID NO: 586259
  misc_feature: HIJSMM301CXPDB.48.45.E01.1.454.light.4.raw

SEQ ID NO: 592462 - DNA, 482 bp, Homo sapiens
  misc_feature: HIJSMM301BX2TU.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgttattttcggccctggaccacagtagatatcaaacgaactgtggctgcaccatt

SEQ ID NO: 592463 - DNA, 503 bp, Homo sapiens; identical to SEQ ID NO: 557698
  misc_feature: HIJSMM301B3BUP.4.39.D06.1.454.light.4.raw

SEQ ID NO: 592464 - DNA, 496 bp, Homo sapiens
  misc_feature: HIJSMM301DNFM7.51.38.D05.1.454.light.4.raw
cgatcgtatacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacgggtcacattggccatcagtggagtccaggcagaggacgaggctgactattattgtcaatcaaacagacaccattggtacttatgtcttcggaactgcgaccaaggtcaccgtctgggtcagcccaaggccaaccccactgt

SEQ ID NO: 592465 - DNA, 524 bp, Homo sapiens
  misc_feature: HIJSMM301DS0RQ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccaacggaccgaaggtaggcaatacaaaccgaactatggcgtgcaccatctgtcttctatcttccccg

SEQ ID NO: 592466 - DNA, 511 bp, Homo sapiens; identical to SEQ ID NO: 548439
  misc_feature: HIJSMM301CR62R.16.46.E02.1.454.light.4.raw

SEQ ID NO: 592467 - DNA, 454 bp, Homo sapiens; identical to SEQ ID NO: 534964
  misc_feature: HIJSMM301C06ZQ.19.86.H09.1.454.light.4.raw

SEQ ID NO: 592468 - DNA, 499 bp, Homo sapiens
  misc_feature: HIJSMM301B4EU9.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttccg

SEQ ID NO: 592469 - DNA, 505 bp, Homo sapiens
  misc_feature: HIJSMM301DRK8W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaaggtggaaatacaaacgaactagtggctgcaccatctgtcttcatcttccccg

SEQ ID NO: 592470 - DNA, 510 bp, Homo sapiens
  misc_feature: HIJSMM301CKCJN.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcat

SEQ ID NO: 592471 - DNA, 525 bp, Homo sapiens
  misc_feature: HIJSMM301EPNIN.17.31.C09.1.454.light.4.raw
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccacctccctcctacgtctacg

SEQ ID NO: 592472 - DNA, 522 bp, Homo sapiens; identical to SEQ ID NO: 540296
  misc_feature: HIJSMM301AJTTG.5.27.C05.1.454.light.4.raw

SEQ ID NO: 592473 - DNA, 486 bp, Homo sapiens
  misc_feature: HIJSMM301CEBGE.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtcggcaggaccgaaggtaggagtatacagacgaa

SEQ ID NO: 592474 - DNA, 476 bp, Homo sapiens; identical to SEQ ID NO: 538026
  misc_feature: HIJSMM301A3KM3.13.76.G10.1.454.light.4.raw

SEQ ID NO: 592475 - DNA, 500 bp, Homo sapiens
  misc_feature: HIJSMM301BXDM8.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggatcagtctgaccgtcctacggtcagcccaaggctcgccccctcggtcactccg

SEQ ID NO: 592476 - DNA, 502 bp, Homo sapiens
  misc_feature: HIJSMM301EGQ7H.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccgaagggaccgaaggtggaagtacaaacgaaactagtggcgtgcaccactctgtcttctatcttcccg

SEQ ID NO: 592477 - DNA, 508 bp, Homo sapiens; identical to SEQ ID NO: 544585
  misc_feature: HIJSMM301AM3YY.48.66.F11.1.454.light.4.raw

SEQ ID NO: 592478 - DNA, 510 bp, Homo sapiens; identical to SEQ ID NO: 535855
  misc_feature: HIJSMM301BHP7J.17.33.C11.1.454.light.4.raw

SEQ ID NO: 592479 - DNA, 466 bp, Homo sapiens; identical to SEQ ID NO: 536398
  misc_feature: HIJSMM301DJG4Q.3.20.B09.1.454.light.4.raw

SEQ ID NO: 592480 - DNA, 498 bp, Homo sapiens; identical to SEQ ID NO: 537020
  misc_feature: HIJSMM301EPXUH.26.26.C04.1.454.light.4.raw

SEQ ID NO: 592481 - DNA, 495 bp, Homo sapiens; identical to SEQ ID NO: 535596
  misc_feature: HIJSMM301BO3EH.10.79.H02.1.454.light.4.raw

SEQ ID NO: 592482 - DNA, 483 bp, Homo sapiens
  misc_feature: HIJSMM301E1RV0.49.34.D01.1.454.light.4.raw
agtcgagagacacgaccggtgctcgatttagatcgtctgtgttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaa

SEQ ID NO: 592483 - DNA, 505 bp, Homo sapiens; identical to SEQ ID NO: 535503
  misc_feature: HIJSMM301DR0OM.8.28.C06.1.454.light.4.raw

SEQ ID NO: 592484 - DNA, 494 bp, Homo sapiens; identical to SEQ ID NO: 539006
  misc_feature: HIJSMM301AILBK.48.1.A01.1.454.light.4.raw

SEQ ID NO: 592485 - DNA, 453 bp, Homo sapiens; identical to SEQ ID NO: 544521
  misc_feature: HIJSMM301CW4QB.19.86.H09.1.454.light.4.raw

SEQ ID NO: 592486 - DNA, 493 bp, Homo sapiens; identical to SEQ ID NO: 536289
  misc_feature: HIJSMM301ENJ5T.14.5.A05.1.454.light.4.raw

SEQ ID NO: 592487 - DNA, 501 bp, Homo sapiens; identical to SEQ ID NO: 535746
  misc_feature: HIJSMM301CDGXG.18.11.A11.1.454.light.4.raw

SEQ ID NO: 592488 - DNA, 483 bp, Homo sapiens
  misc_feature: HIJSMM301CDYQ5.15.49.E05.1.454.light.4.raw
  modified_base (462)..(462): a, c, t, g, unknown or other
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgtcggccaggaccaaggtggaatnaacgaactagtggctgcacat

SEQ ID NO: 592489 - DNA, 512 bp, Homo sapiens; identical to SEQ ID NO: 562782
  misc_feature: HIJSMM301BJY01.7.34.D01.1.454.light.4.raw

SEQ ID NO: 592490 - DNA, 458 bp, Homo sapiens
  misc_feature: HIJSMM301DX33R.40.76.G10.1.454.light.4.raw
  modified_base (414)..(414): a, c, t, g, unknown or other
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaacgatgttgcagtttattactgtcaaaagtntgacactgtcccgctcactttcggcggagggaccaaggtggaga

SEQ ID NO: 592491 - DNA, 502 bp, Homo sapiens; identical to SEQ ID NO: 541971
  misc_feature: HIJSMM301A8QTW.4.39.D06.1.454.light.4.raw

SEQ ID NO: 592492 - DNA, 485 bp, Homo sapiens; identical to SEQ ID NO: 536576
  misc_feature: HIJSMM301EACZU.46.35.D02.1.454.light.4.raw

SEQ ID NO: 592493 - DNA, 511 bp, Homo sapiens; identical to SEQ ID NO: 537464
  misc_feature: HIJSMM301ER7GK.7.34.D01.1.454.light.4.raw

SEQ ID NO: 592494 - DNA, 502 bp, Homo sapiens
  misc_feature: HIJSMM301A0WVY.21.22.B11.1.454.light.4.raw
tcgtcgctcgcacgaccggtgctcgatttagacgacagctcagggtggggtcaaaaacccggggagggggtctgatttgcatggatggactctcccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaaatcctcatccagaggaataatcagcggccctcaggggtccctgaccgattctctggctccaagtctggcacctcagcctcctgaccatcagtgggctccggtccgaggatgaggctgactattc

SEQ ID NO: 592495 - DNA, 495 bp, Homo sapiens
  misc_feature: HIJSMM301CYCQ4.41.37.D04.1.454.light.4.raw
  modified_base (432)..(432): a, c, t, g, unknown or other
tctatactatcacgaccggtgctcgatttagtagcatactgttgggtttgggggcaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggattttgcgacttactattgtcaacaggctgacagtttcccncttcactttcggcggagggaccaaggttgagaccaaacgaactgtggctgcaccatctgtctt

SEQ ID NO: 592496 - DNA, 515 bp, Homo sapiens
  misc_feature: HIJSMM301BAF7H.47.87.H10.1.454.light.4.raw
agctcacgtacacgaccggtgctcgatttagcagtactgcgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatatttttgtcaggtgtgggagactaatttggtcatatgttgttcggcggagggaccaagctgaccgtcctcggtcagcccaaggctgccccctcggtcactctgttcccgccctcct

SEQ ID NO: 592497 - DNA, 487 bp, Homo sapiens; identical to SEQ ID NO: 536025
  misc_feature: HIJSMM301C4V6P.17.34.D01.1.454.light.4.raw

SEQ ID NO: 592498 - DNA, 495 bp, Homo sapiens
  misc_feature: HIJSMM301AUGM9.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcac

SEQ ID NO: 592499 - DNA, 485 bp, Homo sapiens; identical to SEQ ID NO: 541838
  misc_feature: HIJSMM301DDLUE.22.6.A06.1.454.light.4.raw

SEQ ID NO: 592500 - DNA, 497 bp, Homo sapiens; identical to SEQ ID NO: 539718
  misc_feature: HIJSMM301EOBWE.40.54.E10.1.454.light.4.raw

SEQ ID NO: 592501 - DNA, 483 bp, Homo sapiens
  misc_feature: HIJSMM301CAZE1.41.33.C11.1.454.light.4.raw
tctatactatcacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 592502 - DNA, 464 bp, Homo sapiens; identical to SEQ ID NO: 536640
  misc_feature: HIJSMM301BRH3K.26.78.H01.1.454.light.4.raw

SEQ ID NO: 592503 - DNA, 479 bp, Homo sapiens; identical to SEQ ID NO: 542895
  misc_feature: HIJSMM301AXE9Z.40.59.F04.1.454.light.4.raw

SEQ ID NO: 592504 - DNA, 493 bp, Homo sapiens
  misc_feature: HIJSMM301BB5YF.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgactgtggctgcaccatctgtcttcatcttcccgc

SEQ ID NO: 592505 - DNA, 470 bp, Homo sapiens
  misc_feature: HIJSMM301C0HUK.5.4.A04.1.454.light.4.raw
atcagacacgcacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggacaagtcagagcattagcaggtctttaaattggtatcagcacaaaccagggaaagcccctatgctcctgatctttgctgcatccagtttgcaaagtggggtcccatcaaggttcagtggcagtggatctgggacagatttcactctcaccatcagcagtctgcaagctgaagattttgcaacttattactgtcaacaaagttatagtacccgacgttcgccaaggaccaagtggagagtcaaacgaactagtggctgcacc

SEQ ID NO: 592506 - DNA, 489 bp, Homo sapiens; identical to SEQ ID NO: 535139
  misc_feature: HIJSMM301D5W0W.14.55.E11.1.454.light.4.raw

SEQ ID NO: 592507 - DNA, 310 bp, Homo sapiens; identical to SEQ ID NO: 574692
  misc_feature: HIJSMM301B8S58.43.19.B08.1.454.light.4.raw

SEQ ID NO: 592508 - DNA, 489 bp, Homo sapiens; identical to SEQ ID NO: 576120
  misc_feature: HIJSMM301CB5EV.26.78.H01.1.454.light.4.raw

SEQ ID NO: 592509 - DNA, 480 bp, Homo sapiens; identical to SEQ ID NO: 557442
  misc_feature: HIJSMM301BZ6NB.8.53.E09.1.454.light.4.raw

SEQ ID NO: 592510 - DNA, 492 bp, Homo sapiens
  misc_feature: HIJSMM301AHX0Y.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgagccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgccac

SEQ ID NO: 592511 - DNA, 496 bp, Homo sapiens; identical to SEQ ID NO: 550221
  misc_feature: HIJSMM301A51XV.10.79.H02.1.454.light.4.raw

SEQ ID NO: 592512 - DNA, 447 bp, Homo sapiens; identical to SEQ ID NO: 535020
  misc_feature: HIJSMM301BWCY9.18.9.A09.1.454.light.4.raw

SEQ ID NO: 592513 - DNA, 509 bp, Homo sapiens
  misc_feature: HIJSMM301CHKY4.17.2.A02.1.454.light.4.raw
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaacccactgtcactctgttcccgccct

SEQ ID NO: 592514 - DNA, 504 bp, Homo sapiens
  misc_feature: HIJSMM301A60WJ.48.57.F02.1.454.light.4.raw
agtatacatacacgaccggtgctcgatttagctcgatatagttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttccccg

SEQ ID NO: 592515 - DNA, 452 bp, Homo sapiens
  misc_feature: HIJSMM301AD3WP.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctcacgaagta

SEQ ID NO: 592516 - DNA, 521 bp, Homo sapiens; identical to SEQ ID NO: 538715
  misc_feature: HIJSMM301BR7WZ.27.23.C01.1.454.light.4.raw

SEQ ID NO: 592517 - DNA, 447 bp, Homo sapiens; identical to SEQ ID NO: 535020
  misc_feature: HIJSMM301AK5PM.18.9.A09.1.454.light.4.raw

SEQ ID NO: 592518 - DNA, 478 bp, Homo sapiens
  misc_feature: HIJSMM301C0C9F.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagccccaaggctg

SEQ ID NO: 592519 - DNA, 500 bp, Homo sapiens
  misc_feature: HIJSMM301EKMOT.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccagggaccgaaggtggaaatacaaacgaactagtggctgcacc

SEQ ID NO: 592520 - DNA, 484 bp, Homo sapiens
  misc_feature: HIJSMM301AXIKB.48.12.B01.1.454.light.4.raw
agtatacatacacgaccggtgctcgatttagtagtgtagattccgcggggaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggacc

SEQ ID NO: 592521 - DNA, 511 bp, Homo sapiens; identical to SEQ ID NO: 546062
  misc_feature: HIJSMM301D67Y8.5.58.F03.1.454.light.4.raw

SEQ ID NO: 592522 - DNA, 514 bp, Homo sapiens; identical to SEQ ID NO: 543100
  misc_feature: HIJSMM301AOXT2.8.23.C01.1.454.light.4.raw

SEQ ID NO: 592523 - DNA, 507 bp, Homo sapiens
  misc_feature: HIJSMM301CCX5A.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgccact

SEQ ID NO: 592524 - DNA, 392 bp, Homo sapiens; identical to SEQ ID NO: 547445
  misc_feature: HIJSMM301DGNZ0.10.86.H09.1.454.light.4.raw

SEQ ID NO: 592525 - DNA, 485 bp, Homo sapiens; identical to SEQ ID NO: 536040
  misc_feature: HIJSMM301AS337.15.1.A01.1.454.light.4.raw

SEQ ID NO: 592526 - DNA, 497 bp, Homo sapiens; identical to SEQ ID NO: 535286
  misc_feature: HIJSMM301CW5ZJ.18.59.F04.1.454.light.4.raw

SEQ ID NO: 592527 - DNA, 484 bp, Homo sapiens; identical to SEQ ID NO: 535240
  misc_feature: HIJSMM301EVXET.47.60.F05.1.454.light.4.raw

SEQ ID NO: 592528 - DNA, 491 bp, Homo sapiens; identical to SEQ ID NO: 535176
  misc_feature: HIJSMM301AHSLR.13.39.D06.1.454.light.4.raw

SEQ ID NO: 592529 - DNA, 495 bp, Homo sapiens; identical to SEQ ID NO: 538651
  misc_feature: HIJSMM301A3LFC.10.79.H02.1.454.light.4.raw

SEQ ID NO: 592530 - DNA, 499 bp, Homo sapiens
  misc_feature: HIJSMM301DO36Q.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccaaggtgaccgtcctaggtcagcccaaggccg

SEQ ID NO: 592531 - DNA, 447 bp, Homo sapiens; identical to SEQ ID NO: 535020
  misc_feature: HIJSMM301D6K17.18.9.A09.1.454.light.4.raw

SEQ ID NO: 592532 - DNA, 506 bp, Homo sapiens; identical to SEQ ID NO: 550551
  misc_feature: HIJSMM301D6WO1.16.1.A01.1.454.light.4.raw

SEQ ID NO: 592533 - DNA, 486 bp, Homo sapiens
  misc_feature: HIJSMM301DGIY9.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaagtggggtcccatcaaggttcagcggcagtggatctgggacagaattcagtctcaccatcagcagcctgcagcctgacgattttgcaacttactactgccaagtgcataataatcatttcggcggagggaccaagggtggagatcaaacgaactgtggctgcaccatctgtcttcatt

SEQ ID NO: 592534 - DNA, 507 bp, Homo sapiens
  misc_feature: HIJSMM301C9U38.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggtcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggacccaaggtggacctcaaacgaactgtggctgcaccatctgtcttcatcttcccgcc

SEQ ID NO: 592535 - DNA, 496 bp, Homo sapiens; identical to SEQ ID NO: 537225
  misc_feature: HIJSMM301AK1BD.11.59.F04.1.454.light.4.raw

SEQ ID NO: 592536 - DNA, 476 bp, Homo sapiens
  misc_feature: HIJSMM301D2HRX.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagatttttactttcaccatcagcagcctgcagcctgaagatattgcaacatattactgtcagcagtatgataatctcccgatcaccttcggccaagggacacgactggagattaaacgaactgtggctgcacc

SEQ ID NO: 592537 - DNA, 489 bp, Homo sapiens
  misc_feature: HIJSMM301ERXB4.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtccagaccccg

SEQ ID NO: 592538 - DNA, 501 bp, Homo sapiens; identical to SEQ ID NO: 535746
  misc_feature: HIJSMM301D81O5.18.11.A11.1.454.light.4.raw

SEQ ID NO: 592539 - DNA, 513 bp, Homo sapiens; identical to SEQ ID NO: 551867
  misc_feature: HIJSMM301CS7E3.43.19.B08.1.454.light.4.raw

SEQ ID NO: 592540 - DNA, 502 bp, Homo sapiens
  misc_feature: HIJSMM301BUF9B.27.78.H01.1.454.light.4.raw
  modified_base (412)..(412): a, c, t, g, unknown or other
  modified_base (464)..(464): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttactcaagtnatcaccttcggccaagggacacgactggagattaaacg

SEQ ID NO: 592541 - DNA, 485 bp, Homo sapiens; identical to SEQ ID NO: 536040
  misc_feature: HIJSMM301EDQU7.15.1.A01.1.454.light.4.raw

SEQ ID NO: 592542 - DNA, 483 bp, Homo sapiens
  misc_feature: HIJSMM301BQUHC.48.27.C05.1.454.light.4.raw
agtatacatacacgaccggtgctcgatttagacgcgatcgaagggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgatttacaattaccctcggacgttcggccaagggaccaaggtggaagtcaaacgaactagtggctgcacc

SEQ ID NO: 592543 - DNA, 497 bp, Homo sapiens; identical to SEQ ID NO: 538296
  misc_feature: HIJSMM301DB4OP.18.11.A11.1.454.light.4.raw

SEQ ID NO: 592544 - DNA, 503 bp, Homo sapiens
  misc_feature: HIJSMM301ALHGC.2.35.D02.1.454.light.4.raw
acgctcgacacacgaccggtgctcgatttagcacacgatagttgggtttgggggtctcaggagacagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtca

SEQ ID NO: 592545 - DNA, 454 bp, Homo sapiens; identical to SEQ ID NO: 534964
  misc_feature: HIJSMM301BSM0H.19.86.H09.1.454.light.4.raw

SEQ ID NO: 592546 - DNA, 509 bp, Homo sapiens
  misc_feature: HIJSMM301B5QPB.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaagtggatatcaaacgaactagtggctgcaccatctgtcttcta

SEQ ID NO: 592547 - DNA, 502 bp, Homo sapiens
  misc_feature: HIJSMM301DNK5K.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtactcccagccaggttcagtggcaggtgggtctgggacagagttcactctcaccatcagcagcctgcagtctgaagtattttgtcggtttattactgtcagcagtataataactcggcctccacggtactacttttggccgagggaccaagctggagatacaaacgaactgtgctgcacatctgtt

SEQ ID NO: 592548 - DNA, 479 bp, Homo sapiens; identical to SEQ ID NO: 542895
  misc_feature: HIJSMM301BNJM3.40.59.F04.1.454.light.4.raw

SEQ ID NO: 592549 - DNA, 416 bp, Homo sapiens; identical to SEQ ID NO: 545902
  misc_feature: HIJSMM301EMWA0.18.78.H01.1.454.light.4.raw

SEQ ID NO: 592550 - DNA, 497 bp, Homo sapiens; identical to SEQ ID NO: 536371
  misc_feature: HIJSMM301BEWD0.16.78.H01.1.454.light.4.raw

SEQ ID NO: 592551 - DNA, 527 bp, Homo sapiens
  misc_feature: HIJSMM301AUWWN.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtattatgggttttgggtcgatttcggttgttcgggtcgggaggggacccgacggtgaccggtcctaccgtcacgcccaacgg

SEQ ID NO: 592552 - DNA, 512 bp, Homo sapiens
  misc_feature: HIJSMM301ELM83.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggaggaccaagctgaccgtctaagtcagcccaaggctgccccctcggtcactctgttcccaccctcct

SEQ ID NO: 592553 - DNA, 484 bp, Homo sapiens
  misc_feature: HIJSMM301DDM2N.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaggtggagatcaaacgaact

SEQ ID NO: 592554 - DNA, 495 bp, Homo sapiens; identical to SEQ ID NO: 543094
  misc_feature: HIJSMM301EC682.22.57.F02.1.454.light.4.raw

SEQ ID NO: 592555 - DNA, 504 bp, Homo sapiens; identical to SEQ ID NO: 556255
  misc_feature: HIJSMM301BOJ3D.48.26.C04.1.454.light.4.raw

SEQ ID NO: 592556 - DNA, 486 bp, Homo sapiens
  misc_feature: HIJSMM301EFGES.52.59.F04.1.454.light.4.raw
  modified_base (339)..(339): a, c, t, g, unknown or other
cgcagtacgacacgaccggtgctcgatttagtacacacacttagggattggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcagtcaggtcattaacagttatttagcctggtatcagcaaaaaccagggcaagttcctgaactcctgatctatgacacatccactttgcaatcaggggtcccatctcggttcgttggcngtgggtctgggacagtattttactcttcaccatcagcagcctgcagcctgaagatgttgctaacttatttctgtcattaactatgatgatcgcccctcaccacgtttccggccaacggggaccaacgctaggaaatacaaacgaact

SEQ ID NO: 592557 - DNA, 484 bp, Homo sapiens; identical to SEQ ID NO: 535400
  misc_feature: HIJSMM301B6ZRO.46.26.C04.1.454.light.4.raw

SEQ ID NO: 592558 - DNA, 503 bp, Homo sapiens; identical to SEQ ID NO: 547049
  misc_feature: HIJSMM301AGLAB.18.59.F04.1.454.light.4.raw

SEQ ID NO: 592559 - DNA, 466 bp, Homo sapiens; identical to SEQ ID NO: 546958
  misc_feature: HIJSMM301DV3O9.11.70.G04.1.454.light.4.raw

SEQ ID NO: 592560 - DNA, 506 bp, Homo sapiens; identical to SEQ ID NO: 555342
  misc_feature: HIJSMM301B3Q2N.48.21.B10.1.454.light.4.raw

SEQ ID NO: 592561 - DNA, 447 bp, Homo sapiens; identical to SEQ ID NO: 535020
  misc_feature: HIJSMM301AMOB3.18.9.A09.1.454.light.4.raw

SEQ ID NO: 592562 - DNA, 447 bp, Homo sapiens; identical to SEQ ID NO: 535201
  misc_feature: HIJSMM301AS4OH.18.9.A09.1.454.light.4.raw

SEQ ID NO: 592563 - DNA, 460 bp, Homo sapiens; identical to SEQ ID NO: 537107
  misc_feature: HIJSMM301CM2S3.22.28.C06.1.454.light.4.raw

SEQ ID NO: 592564 - DNA, 489 bp, Homo sapiens; identical to SEQ ID NO: 535139
  misc_feature: HIJSMM301BQ1F6.14.55.E11.1.454.light.4.raw

SEQ ID NO: 592565 - DNA, 489 bp, Homo sapiens; identical to SEQ ID NO: 535139
  misc_feature: HIJSMM301DQKM9.14.55.E11.1.454.light.4.raw

SEQ ID NO: 592566 - DNA, 488 bp, Homo sapiens; identical to SEQ ID NO: 537260
  misc_feature: HIJSMM301A85JG.47.70.G04.1.454.light.4.raw

SEQ ID NO: 592567 - DNA, 493 bp, Homo sapiens; identical to SEQ ID NO: 549803
  misc_feature: HIJSMM301D7OYS.13.56.F01.1.454.light.4.raw

SEQ ID NO: 592568 - DNA, 447 bp, Homo sapiens; identical to SEQ ID NO: 535201
  misc_feature: HIJSMM301A1BA4.18.9.A09.1.454.light.4.raw

SEQ ID NO: 592569 - DNA, 494 bp, Homo sapiens; identical to SEQ ID NO: 540110
  misc_feature: HIJSMM301AF9LQ.51.71.G05.1.454.light.4.raw

SEQ ID NO: 592570 - DNA, 503 bp, Homo sapiens
  misc_feature: HIJSMM301DEGLF.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctgggctccaagtctggcaacacggcctccctgaccgtctctgggctccaggctgaagatgaggctgattattactgctgctcatatgcaggccgcaacagtgatctattcggcggagggaccaagctgaccgtctaggtcagcccaaggctgccccctc

SEQ ID NO: 592571 - DNA, 489 bp, Homo sapiens; identical to SEQ ID NO: 557621
  misc_feature: HIJSMM301CMQBG.13.87.H10.1.454.light.4.raw

SEQ ID NO: 592572 - DNA, 499 bp, Homo sapiens; identical to SEQ ID NO: 537739
  misc_feature: HIJSMM301CVPE9.12.86.H09.1.454.light.4.raw

SEQ ID NO: 592573 - DNA, 447 bp, Homo sapiens; identical to SEQ ID NO: 535020
  misc_feature: HIJSMM301BCXOQ.18.9.A09.1.454.light.4.raw

SEQ ID NO: 592574 - DNA, 480 bp, Homo sapiens; identical to SEQ ID NO: 578243
  misc_feature: HIJSMM301EXT0K.40.59.F04.1.454.light.4.raw

SEQ ID NO: 592575 - DNA, 447 bp, Homo sapiens; identical to SEQ ID NO: 535201
  misc_feature: HIJSMM301D43RW.18.9.A09.1.454.light.4.raw

SEQ ID NO: 592576 - DNA, 523 bp, Homo sapiens
  misc_feature: HIJSMM301DFZOZ.16.59.F04.1.454.light.4.raw
tgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccacctcctcgagtagtaca

SEQ ID NO: 592577 - DNA, 485 bp, Homo sapiens; identical to SEQ ID NO: 536210
  misc_feature: HIJSMM301DLGPE.43.54.E10.1.454.light.4.raw

SEQ ID NO: 592578 - DNA, 475 bp, Homo sapiens; identical to SEQ ID NO: 570411
  misc_feature: HIJSMM301BI1IJ.13.39.D06.1.454.light.4.raw

SEQ ID NO: 592579 - DNA, 522 bp, Homo sapiens; identical to SEQ ID NO: 540226
  misc_feature: HIJSMM301CD849.27.23.C01.1.454.light.4.raw

SEQ ID NO: 592580 - DNA, 483 bp, Homo sapiens; identical to SEQ ID NO: 535413
  misc_feature: HIJSMM301AFM97.26.78.H01.1.454.light.4.raw

SEQ ID NO: 592581 - DNA, 474 bp, Homo sapiens
  misc_feature: HIJSMM301DPJEW.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 592582 - DNA, 481 bp, Homo sapiens
  misc_feature: HIJSMM301CN8SH.43.81.H04.1.454.light.4.raw
tgtgagtagtcacgaccggtgctcgatttagtagtgtagattcgcgggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcaccatt

SEQ ID NO: 592583 - DNA, 504 bp, Homo sapiens
  misc_feature: HIJSMM301B3CJ4.49.53.E09.1.454.light.4.raw
agtcgagagacacgaccggtgctcgatttagagagagtgtgttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactatgtctccgtgttttcggcggagggaccaggctgaccgtcctgggtcagcccaaggctcgccccctcggtcactcttccg

SEQ ID NO: 592584 - DNA, 509 bp, Homo sapiens; identical to SEQ ID NO: 570166
  misc_feature: HIJSMM301AU88L.47.55.E11.1.454.light.4.raw

SEQ ID NO: 592585 - DNA, 507 bp, Homo sapiens
  misc_feature: HIJSMM301DOXB9.9.53.E09.1.454.light.4.raw
  modified_base (376)..(376): a, c, t, g, unknown or other
tgatacgtctcacgaccggtgctcgatttagagagagtgtgttgggtttggggggggtcgacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccccganaatctctgggctccaggctgaggacgaggctgattattactgctgctcatatgcagatggtgacactcccgtggtattcggcggagggaccaaggtgaccggtcctaggtcagcccaaggctgccccctcc

SEQ ID NO: 592586 - DNA, 499 bp, Homo sapiens; identical to SEQ ID NO: 543887
  misc_feature: HIJSMM301BH9GX.10.65.F10.1.454.light.4.raw

SEQ ID NO: 592587 - DNA, 481 bp, Homo sapiens
  misc_feature: HIJSMM301E0YQ6.51.68.G02.1.454.light.4.raw
  modified_base (463)..(463): a, c, t, g, unknown or other
cgatcgtatacacgaccggtgctcgatttagtcgatagtgaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtccncggtcagcccaaggctcg

SEQ ID NO: 592588 - DNA, 483 bp, Homo sapiens
  misc_feature: HIJSMM301DMODR.52.77.G11.1.454.light.4.raw
cgcagtacgacacgaccggtgctcgatttagctagtcactcaagggaaaggggagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccaaggtggagatcaaacgaactgtggctgcaccatctgtt

SEQ ID NO: 592589 - DNA, 487 bp, Homo sapiens; identical to SEQ ID NO: 554782
  misc_feature: HIJSMM301AQYBH.46.35.D02.1.454.light.4.raw

SEQ ID NO: 592590 - DNA, 495 bp, Homo sapiens
  misc_feature: HIJSMM301ERHH4.52.83.H06.1.454.light.4.raw
cgcagtacgacacgaccggtgctcgatttagatcacgtgcgtcgcgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcacttcggtcggacgggaccaaggtacgaggatcaaaccaaacgtagtggctgcaccactcttc

SEQ ID NO: 592591 - DNA, 485 bp, Homo sapiens; identical to SEQ ID NO: 536040
  misc_feature: HIJSMM301EJMU0.15.1.A01.1.454.light.4.raw

SEQ ID NO: 592592 - DNA, 487 bp, Homo sapiens
  misc_feature: HIJSMM301BSBVI.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtatctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgtaacg

SEQ ID NO: 592593 - DNA, 486 bp, Homo sapiens
  misc_feature: HIJSMM301A681D.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccaggggaccaagctggagatacaaacgaactgtggctgcaccat

SEQ ID NO: 592594 - DNA, 445 bp, Homo sapiens; identical to SEQ ID NO: 546083
  misc_feature: HIJSMM301AEIZU.5.9.A09.1.454.light.4.raw

SEQ ID NO: 592595 - DNA, 519 bp, Homo sapiens
  misc_feature: HIJSMM301ARR0Z.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctggtcactctgttcccgccct

SEQ ID NO: 592596 - DNA, 516 bp, Homo sapiens
  misc_feature: HIJSMM301CT7I9.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctcccgggggccacctttcggtccctcgggaccgaacggtggaggagtcaaacgaactagtggctgcaccatctgtcttctact

SEQ ID NO: 592597 - DNA, 495 bp, Homo sapiens; identical to SEQ ID NO: 535821
  misc_feature: HIJSMM301CX4FX.3.31.C09.1.454.light.4.raw

SEQ ID NO: 592598 - DNA, 384 bp, Homo sapiens; identical to SEQ ID NO: 555393
  misc_feature: HIJSMM301BX8UE.48.87.H10.1.454.light.4.raw

SEQ ID NO: 592599 - DNA, 494 bp, Homo sapiens; identical to SEQ ID NO: 534994
  misc_feature: HIJSMM301ALEXR.27.78.H01.1.454.light.4.raw

SEQ ID NO: 592600 - DNA, 506 bp, Homo sapiens
  misc_feature: HIJSMM301BTGTZ.2.71.G05.1.454.light.4.raw
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactc

SEQ ID NO: 592601 - DNA, 485 bp, Homo sapiens; identical to SEQ ID NO: 536040
  misc_feature: HIJSMM301CY41P.15.1.A01.1.454.light.4.raw

SEQ ID NO: 592602 - DNA, 507 bp, Homo sapiens
  misc_feature: HIJSMM301DX78U.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaaggctgaccgtcctgggtcagcccaaggctgccccctcggtctacc

SEQ ID NO: 592603 - DNA, 485 bp, Homo sapiens; identical to SEQ ID NO: 536576
  misc_feature: HIJSMM301BIV3S.46.35.D02.1.454.light.4.raw

SEQ ID NO: 592604 - DNA, 468 bp, Homo sapiens
  misc_feature: HIJSMM301CAIFY.43.49.E05.1.454.light.4.raw
tgtgagtagtcacgaccggtgctcgatttagagcgactagcaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacactcactctcacctgtgactccagcactggaactgtcaccagtggtcatttttcccactggttccaacagaagcctggccaagcccccaggacactgatttttgatgcagacaacagacactcctggacacctgcccgattctcaggctccctccttggggacaaggctgccctgcccctttcgggtgcggcagagggaccaccctgcccttccttagtcagcccaaggctgccccctcggtcactctgttcccgccctcctcactactcaca

SEQ ID NO: 592605 - DNA, 489 bp, Homo sapiens; identical to SEQ ID NO: 535139
  misc_feature: HIJSMM301A6LJ6.14.55.E11.1.454.light.4.raw

SEQ ID NO: 592606 - DNA, 499 bp, Homo sapiens
  misc_feature: HIJSMM301DBX17.52.2.A02.1.454.light.4.raw
cgcagtacgacacgaccggtgctcgatttagactcatctacaggggaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagcctgtggggcagggtcagcccaaggccaacccactgtcactctgttcccgccctcctcctatacgatcg

SEQ ID NO: 592607 - DNA, 508 bp, Homo sapiens
  misc_feature: HIJSMM301D5AZT.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctgtcactctgttcccaccctcc

SEQ ID NO: 592608 - DNA, 486 bp, Homo sapiens; identical to SEQ ID NO: 538918
  misc_feature: HIJSMM301C1E1F.47.38.D05.1.454.light.4.raw

SEQ ID NO: 592609 - DNA, 511 bp, Homo sapiens
  misc_feature: HIJSMM301BXP4X.47.85.H08.1.454.light.4.raw
agctcacgtacacgaccggtgctcgatttagtatcactcagtcgcggggggtctcaggaggcagcgctctcaggacatctccaccatggcctgggctctgctgctcctcaccctcctcactcggggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccca

SEQ ID NO: 592610 - DNA, 493 bp, Homo sapiens; identical to SEQ ID NO: 535047
  misc_feature: HIJSMM301D11DF.16.53.E09.1.454.light.4.raw

SEQ ID NO: 592611 - DNA, 501 bp, Homo sapiens; identical to SEQ ID NO: 535746
  misc_feature: HIJSMM301DTVRM.18.11.A11.1.454.light.4.raw

SEQ ID NO: 592612 - DNA, 499 bp, Homo sapiens; identical to SEQ ID NO: 543360
  misc_feature: HIJSMM301D7UHM.19.78.H01.1.454.light.4.raw

SEQ ID NO: 592613 - DNA, 502 bp, Homo sapiens
  misc_feature: HIJSMM301BVAY3.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatggaggctgactattattgtgcagcgtgggatgacggtctgagtgctgtggtcttcgggcggagggaccaagctgaccgtcctgggtcagcccaac

SEQ ID NO: 592614 - DNA, 496 bp, Homo sapiens
  misc_feature: HIJSMM301B5X00.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaacccc

SEQ ID NO: 592615 - DNA, 507 bp, Homo sapiens
  misc_feature: HIJSMM301D5O69.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtattggtggagggaccaagctgaccgtcctaggtcagcccaaggctgccccctcggt

SEQ ID NO: 592616 - DNA, 509 bp, Homo sapiens
  misc_feature: HIJSMM301B27V0.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcgggagggaccaagctgaccgtcctcggtcagcccaaggctcgccccctcggtccactcctcgttcccaccctccc

SEQ ID NO: 592617 - DNA, 510 bp, Homo sapiens; identical to SEQ ID NO: 586919
  misc_feature: HIJSMM301AWEZ8.47.85.H08.1.454.light.4.raw

SEQ ID NO: 592618 - DNA, 505 bp, Homo sapiens; identical to SEQ ID NO: 539292
  misc_feature: HIJSMM301BZ1A0.19.85.H08.1.454.light.4.raw

SEQ ID NO: 592619 - DNA, 485 bp, Homo sapiens; identical to SEQ ID NO: 578148
  misc_feature: HIJSMM301DHGKW.46.35.D02.1.454.light.4.raw

SEQ ID NO: 592620 - DNA, 506 bp, Homo sapiens
  misc_feature: HIJSMM301DTGPN.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctcgtt

SEQ ID NO: 592621 - DNA, 493 bp, Homo sapiens; identical to SEQ ID NO: 565283
  misc_feature: HIJSMM301AMTPC.43.82.H05.1.454.light.4.raw

SEQ ID NO: 592622 - DNA, 496 bp, Homo sapiens; identical to SEQ ID NO: 538376
  misc_feature: HIJSMM301E2J63.51.23.C01.1.454.light.4.raw

SEQ ID NO: 592623 - DNA, 513 bp, Homo sapiens
  misc_feature: HIJSMM301EZ589.43.27.C05.1.454.light.4.raw
tgtgagtagtcacgaccggtgctcgatttagacgcgatcgaagggtttggggagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagctttcactctcaccgtcagcagcctgcagtctgaagattttgcaacttattactgtctacaagattcttcttaccctcggacgttcggtccacgggaccgaccggtggacgtgtctaagcgaactacgtggctgcaccactctgtcttctactcttcccgtcccact

SEQ ID NO: 592624 - DNA, 504 bp, Homo sapiens; identical to SEQ ID NO: 550923
  misc_feature: HIJSMM301B3G5C.51.2.A02.1.454.light.4.raw

SEQ ID NO: 592625 - DNA, 506 bp, Homo sapiens; identical to SEQ ID NO: 563474
  misc_feature: HIJSMM301AWL7M.10.27.C05.1.454.light.4.raw

SEQ ID NO: 592626 - DNA, 484 bp, Homo sapiens; identical to SEQ ID NO: 535211
  misc_feature: HIJSMM301C2FKH.47.46.E02.1.454.light.4.raw

SEQ ID NO: 592627 - DNA, 485 bp, Homo sapiens; identical to SEQ ID NO: 536576
  misc_feature: HIJSMM301BW40Y.46.35.D02.1.454.light.4.raw

SEQ ID NO: 592628 - DNA, 500 bp, Homo sapiens; identical to SEQ ID NO: 540012
  misc_feature: HIJSMM301AQRN6.52.34.D01.1.454.light.4.raw

SEQ ID NO: 592629 - DNA, 521 bp, Homo sapiens; identical to SEQ ID NO: 538715
  misc_feature: HIJSMM301ASF7X.27.23.C01.1.454.light.4.raw

SEQ ID NO: 592630 - DNA, 502 bp, Homo sapiens; identical to SEQ ID NO: 541971
  misc_feature: HIJSMM301ET4V4.4.39.D06.1.454.light.4.raw

SEQ ID NO: 592631 - DNA, 496 bp, Homo sapiens
  misc_feature: HIJSMM301AJPU4.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcacttc

SEQ ID NO: 592632 - DNA, 510 bp, Homo sapiens; identical to SEQ ID NO: 541826
  misc_feature: HIJSMM301D8IE4.17.33.C11.1.454.light.4.raw
  modified_base (504)..(504): a, c, t, g, unknown or other

SEQ ID NO: 592633 - DNA, 529 bp, Homo sapiens
  misc_feature: HIJSMM301B7RB0.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggaggtacgacggtggaccgtcctaggtcgagcccaacggacgtgcccccgtccggtccgactcctgttcccta

SEQ ID NO: 592634 - DNA, 496 bp, Homo sapiens
  misc_feature: HIJSMM301BOLOH.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaactaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatgggtgggcggcggtcgttttcgggcgggggaccgaaggtggacatacaaacgaactgtggctgcaccatctgtt

SEQ ID NO: 592635 - DNA, 522 bp, Homo sapiens; identical to SEQ ID NO: 574183
  misc_feature: HIJSMM301A3SNF.27.23.C01.1.454.light.4.raw
  modified_base (518)..(518): a, c, t, g, unknown or other

SEQ ID NO: 592636 - DNA, 496 bp, Homo sapiens
  misc_feature: HIJSMM301BDMC5.5.57.F02.1.454.light.4.raw
  modified_base (418)..(418): a, c, t, g, unknown or other
  modified_base (483)..(483): a, c, t, g, unknown or other
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatgtcccaaccagattcagtggcagaggtctgggacagacttcagtctcaccatcagcagcgtacagtctgaagacttggcagtttatactgtcaacaatgnggtcagtggcctcgaacgttcggcccagggaccacagtggatatcaggcgaaactgtggctcggnacccatctgtctt

SEQ ID NO: 592637 - DNA, 512 bp, Homo sapiens
  misc_feature: HIJSMM301ELDGS.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatggatagcagcctgagtactgtgataatcggcggagggaccaagctgaccgtcctaggtcagcccaaggctcgccccctggtccactctcgttcccta

SEQ ID NO: 592638 - DNA, 479 bp, Homo sapiens; identical to SEQ ID NO: 542895
  misc_feature: HIJSMM301CV966.40.59.F04.1.454.light.4.raw

SEQ ID NO: 592639 - DNA, 507 bp, Homo sapiens
  misc_feature: HIJSMM301AV7V2.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaaccccactgtcta

SEQ ID NO: 592640 - DNA, 502 bp, Homo sapiens
  misc_feature: HIJSMM301C85VO.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaatgggaccaaggtcaccgtcctaggtcagcccaagccaacccactgtca

SEQ ID NO: 592641 - DNA, 473 bp, Homo sapiens
  misc_feature: HIJSMM301DF2B2.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctggaccgagagtggacgatgaaacgaactatggctg

SEQ ID NO: 592642 - DNA, 506 bp, Homo sapiens; identical to SEQ ID NO: 535404
  misc_feature: HIJSMM301DNQHJ.10.88.H11.1.454.light.4.raw

SEQ ID NO: 592643 - DNA, 510 bp, Homo sapiens
  misc_feature: HIJSMM301B4BVC.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattacttgcagctcatatgcaggcagcagcagtccccatgtgatcttcggcggggggaccaaggctgaccgtcctaggtcagcccaaggctgtccccccg

SEQ ID NO: 592644 - DNA, 484 bp, Homo sapiens; identical to SEQ ID NO: 535400
  misc_feature: HIJSMM301AUW3D.46.26.C04.1.454.light.4.raw

SEQ ID NO: 592645 - DNA, 441 bp, Homo sapiens; identical to SEQ ID NO: 534971
  misc_feature: HIJSMM301CM6BY.11.3.A03.1.454.light.4.raw

SEQ ID NO: 592646 - DNA, 489 bp, Homo sapiens
  misc_feature: HIJSMM301BO5GM.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaaagctgaccgtcctacgtcagcccaaggctgccccctc

SEQ ID NO: 592647 - DNA, 454 bp, Homo sapiens; identical to SEQ ID NO: 534964
  misc_feature: HIJSMM301B2MMQ.19.86.H09.1.454.light.4.raw

SEQ ID NO: 592648 - DNA, 478 bp, Homo sapiens
  misc_feature: HIJSMM301CD8ZR.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctcgtacagttttgtccagggaccaagctggagatcaaacgaa

SEQ ID NO: 592649 - DNA, 498 bp, Homo sapiens
  misc_feature: HIJSMM301EM3T2.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaaactccctcaacgttcggcggaggggaccaaaggtggaagatcaaacgaaactgtggctgcaccatctgtctttca

SEQ ID NO: 592650 - DNA, 460 bp, Homo sapiens; identical to SEQ ID NO: 537107
  misc_feature: HIJSMM301A1EXY.22.28.C06.1.454.light.4.raw

SEQ ID NO: 592651 - DNA, 495 bp, Homo sapiens; identical to SEQ ID NO: 538920
  misc_feature: HIJSMM301DFGN5.47.64.F09.1.454.light.4.raw

SEQ ID NO: 592652 - DNA, 513 bp, Homo sapiens
  misc_feature: HIJSMM301DJUWZ.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagccaaggctgccccctcggtcactctgttccccg

SEQ ID NO: 592653 - DNA, 500 bp, Homo sapiens; identical to SEQ ID NO: 539795
  misc_feature: HIJSMM301C4XH8.22.38.D05.1.454.light.4.raw

SEQ ID NO: 592654 - DNA, 504 bp, Homo sapiens
  misc_feature: HIJSMM301C2CNN.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgccctccaagtccggcacctcacgcctccctggccatcagtgggctccgggccgaggatgaggctgattattactgtgcaggatgggatgacaacctgggtgcttatctcttcggacctgggaccaaggtcaccgtcctggt

SEQ ID NO: 592655 - DNA, 512 bp, Homo sapiens; identical to SEQ ID NO: 552150
  misc_feature: HIJSMM301DR9UV.17.33.C11.1.454.light.4.raw

SEQ ID NO: 592656 - DNA, 491 bp, Homo sapiens
  misc_feature: HIJSMM301D1IOX.52.29.C07.1.454.light.4.raw
cgcagtacgacacgaccggtgctcgatttagagtgctacgaagggaaagggggaagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtacacttttggccagggggaccaaagctggagatcaaacgaactgtggctgcacc

SEQ ID NO: 592657 - DNA, 469 bp, Homo sapiens
  misc_feature: HIJSMM301AXEJV.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggagatcaagcgaact

SEQ ID NO: 592658 - DNA, 502 bp, Homo sapiens
  misc_feature: HIJSMM301C73DG.48.41.D08.1.454.light.4.raw
agtatacatacacgaccggtgctcgatttagtcacgcgagaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccta

SEQ ID NO: 592659 - DNA, 480 bp, Homo sapiens; identical to SEQ ID NO: 549459
  misc_feature: HIJSMM301C31HD.21.25.C03.1.454.light.4.raw

SEQ ID NO: 592660 - DNA, 494 bp, Homo sapiens; identical to SEQ ID NO: 535828
  misc_feature: HIJSMM301B2BT6.3.36.D03.1.454.light.4.raw

SEQ ID NO: 592661 - DNA, 495 bp, Homo sapiens
  misc_feature: HIJSMM301ES8G0.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactt

SEQ ID NO: 592662 - DNA, 499 bp, Homo sapiens
  misc_feature: HIJSMM301BDHGM.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcaccta

SEQ ID NO: 592663 - DNA, 513 bp, Homo sapiens; identical to SEQ ID NO: 562672
  misc_feature: HIJSMM301AKQRL.40.12.B01.1.454.light.4.raw

SEQ ID NO: 592664 - DNA, 479 bp, Homo sapiens; identical to SEQ ID NO: 547474
  misc_feature: HIJSMM301ADTH0.41.17.B06.1.454.light.4.raw

SEQ ID NO: 592665 - DNA, 507 bp, Homo sapiens
  misc_feature: HIJSMM301B04KM.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggaggatcaaacgaactgtggctgcaccatctgt

SEQ ID NO: 592666 - DNA, 486 bp, Homo sapiens
  misc_feature: HIJSMM301B6EXA.26.60.F05.1.454.light.4.raw
  modified_base (481)..(481): a, c, t, g, unknown or other
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctccgnaccat

SEQ ID NO: 592667 - DNA, 487 bp, Homo sapiens; identical to SEQ ID NO: 536536
  misc_feature: HIJSMM301CCRZP.26.45.E01.1.454.light.4.raw

SEQ ID NO: 592668 - DNA, 486 bp, Homo sapiens
  misc_feature: HIJSMM301CELET.49.81.H04.1.454.light.4.raw
agtcgagagacacgaccggtgctcgatttagtagtgtagattcgcggggcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatcttaccactcactttcggcggagggaccacggtggagatcaaacgaactagtggctgcaccatctgtctt

SEQ ID NO: 592669 - DNA, 505 bp, Homo sapiens; identical to SEQ ID NO: 535503
  misc_feature: HIJSMM301DMCLM.8.28.C06.1.454.light.4.raw

SEQ ID NO: 592670 - DNA, 506 bp, Homo sapiens; identical to SEQ ID NO: 534969
  misc_feature: HIJSMM301C7CLZ.18.37.D04.1.454.light.4.raw

SEQ ID NO: 592671 - DNA, 495 bp, Homo sapiens
  misc_feature: HIJSMM301CT8E4.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggcccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgtt

SEQ ID NO: 592672 - DNA, 487 bp, Homo sapiens
  misc_feature: HIJSMM301CPRE9.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaagttgagatcaaacgaactgtggctgcaccatctgt

SEQ ID NO: 592673 - DNA, 491 bp, Homo sapiens
  misc_feature: HIJSMM301AGM0F.3.33.C11.1.454.light.4.raw
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggct

SEQ ID NO: 592674 - DNA, 494 bp, Homo sapiens; identical to SEQ ID NO: 539784
  misc_feature: HIJSMM301A2QUB.22.57.F02.1.454.light.4.raw

SEQ ID NO: 592675 - DNA, 488 bp, Homo sapiens
  misc_feature: HIJSMM301EIPPT.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaaacaatattttagtgctccgtacacttttggccaggggaccaagttggagatcaaacgaa

SEQ ID NO: 592676 - DNA, 504 bp, Homo sapiens; identical to SEQ ID NO: 561241
  misc_feature: HIJSMM301CQJUX.10.71.G05.1.454.light.4.raw

SEQ ID NO: 592677 - DNA, 486 bp, Homo sapiens
  misc_feature: HIJSMM301EKTBH.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggaggaccaaggtgagatcaaacgaactgtggctgcaccatct

SEQ ID NO: 592678 - DNA, 504 bp, Homo sapiens; identical to SEQ ID NO: 552754
  misc_feature: HIJSMM301EMLCR.2.35.D02.1.454.light.4.raw

SEQ ID NO: 592679 - DNA, 470 bp, Homo sapiens
  misc_feature: HIJSMM301C6V7P.15.8.A08.1.454.light.4.raw
  modified_base (345)..(345): a, c, t, g, unknown or other
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgnagtctgaagattttgcagtttattactgtcagcaatataacaagtggccattcactttcggcccagggaccaaagtggatatcaaacgaactgtggctgcaccatctgtcttcatcttccgccat

SEQ ID NO: 592680 - DNA, 443 bp, Homo sapiens
  misc_feature: HIJSMM301BTINP.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgtcccaccctcctcgacacgcgag

SEQ ID NO: 592681 - DNA, 474 bp, Homo sapiens; identical to SEQ ID NO: 561309
  misc_feature: HIJSMM301ANSS5.5.12.B01.1.454.light.4.raw

SEQ ID NO: 592682 - DNA, 485 bp, Homo sapiens; identical to SEQ ID NO: 538533
  misc_feature: HIJSMM301DDJY5.47.78.H01.1.454.light.4.raw

SEQ ID NO: 592683 - DNA, 486 bp, Homo sapiens; identical to SEQ ID NO: 535481
  misc_feature: HIJSMM301DZCFW.17.21.B10.1.454.light.4.raw

SEQ ID NO: 592684 - DNA, 492 bp, Homo sapiens
  misc_feature: HIJSMM301CAXRT.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaacctgtggctgca

SEQ ID NO: 592685 - DNA, 481 bp, Homo sapiens; identical to SEQ ID NO: 544259
  misc_feature: HIJSMM301C621R.3.38.D05.1.454.light.4.raw

SEQ ID NO: 592686 - DNA, 468 bp, Homo sapiens
  misc_feature: HIJSMM301AHF6J.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccgaaggtggaggatcaaacgaa

SEQ ID NO: 592687 - DNA, 485 bp, Homo sapiens; identical to SEQ ID NO: 536040
  misc_feature: HIJSMM301DSR3T.15.1.A01.1.454.light.4.raw

SEQ ID NO: 592688 - DNA, 487 bp, Homo sapiens
  misc_feature: HIJSMM301AM7VD.47.46.E02.1.454.light.4.raw
agctcacgtacacgaccggtgctcgatttagactcatctacagggaaaggggggggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccatct

SEQ ID NO: 592689 - DNA, 508 bp, Homo sapiens; identical to SEQ ID NO: 543419
  misc_feature: HIJSMM301CANER.4.10.A10.1.454.light.4.raw

SEQ ID NO: 592690 - DNA, 484 bp, Homo sapiens
  misc_feature: HIJSMM301AGPS8.43.36.D03.1.454.light.4.raw
  modified_base (307)..(307): a, c, t, g, unknown or other
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttacnggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 592691 - DNA, 518 bp, Homo sapiens; identical to SEQ ID NO: 542842
  misc_feature: HIJSMM301A2JZS.8.87.H10.1.454.light.4.raw

SEQ ID NO: 592692 - DNA, 524 bp, Homo sapiens
  misc_feature: HIJSMM301E2Q7Y.8.23.C01.1.454.light.4.raw
ctcgcgtgtccacgaccggtgctcgatttagtacacgtgattagggattggggctgggcctcaggaagcagcatcggggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaacccccactagtcacctctcgttccctacccctccctcgaccg

SEQ ID NO: 592693 - DNA, 504 bp, Homo sapiens
  misc_feature: HIJSMM301EFV9Q.41.57.F02.1.454.light.4.raw
tctatactatcacgaccggtgctcgatttagctcgatatagttgggtttggggggggtcacaagaggcagcgctctcgggacgtctccaccatggcctgggctctgctgctcctcactctcctcactcaggacacagggtcctgggcccagtctgccctgactcagcctgactccgtgtctgggtctcctggacagtcgatcaccatctcctgcactggaaccaacagtgatgttgggaattataaccttgtctcctggtaccaacaccacccaggcaaagcccccaaactcataatttatgagggcagtaagcggccctcaggggtttctaatcgcttctctggctccaagtctggcaacacggcctccctgacaatctctggactccaggctgaggacgaggctgattattactgcagctcatatacaagcagcagcactctcgtggtattcggcggagggaccaagctgaccgtcctaggtcagcccaaggctgccccctc

SEQ ID NO: 592694 - DNA, 515 bp, Homo sapiens; identical to SEQ ID NO: 536247
  misc_feature: HIJSMM301DA89V.14.19.B08.1.454.light.4.raw

SEQ ID NO: 592695 - DNA, 505 bp, Homo sapiens; identical to SEQ ID NO: 567186
  misc_feature: HIJSMM301DRSN0.9.71.G05.1.454.light.4.raw

SEQ ID NO: 592696 - DNA, 476 bp, Homo sapiens; identical to SEQ ID NO: 538026
  misc_feature: HIJSMM301CFNPP.13.76.G10.1.454.light.4.raw

SEQ ID NO: 592697 - DNA, 520 bp, Homo sapiens; identical to SEQ ID NO: 537173
  misc_feature: HIJSMM301C6GDR.27.23.C01.1.454.light.4.raw

SEQ ID NO: 592698 - DNA, 495 bp, Homo sapiens; identical to SEQ ID NO: 535486
  misc_feature: HIJSMM301A1U61.26.72.G06.1.454.light.4.raw

SEQ ID NO: 592699 - DNA, 501 bp, Homo sapiens; identical to SEQ ID NO: 536142
  misc_feature: HIJSMM301BZA3L.15.1.A01.1.454.light.4.raw

SEQ ID NO: 592700 - DNA, 497 bp, Homo sapiens
  misc_feature: HIJSMM301EQ7XO.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 592701 - DNA, 508 bp, Homo sapiens; identical to SEQ ID NO: 550683
  misc_feature: HIJSMM301EBJ7Q.47.55.E11.1.454.light.4.raw

SEQ ID NO: 592702 - DNA, 500 bp, Homo sapiens; identical to SEQ ID NO: 535310
  misc_feature: HIJSMM301DSCD2.47.66.F11.1.454.light.4.raw

SEQ ID NO: 592703 - DNA, 470 bp, Homo sapiens
  misc_feature: HIJSMM301B9O32.48.51.E07.1.454.light.4.raw
agtatacatacacgaccggtgctcgatttagcatactctacaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgacccgtacaattttggccaggggaccaagctggagatcaacgaa

SEQ ID NO: 592704 - DNA, 486 bp, Homo sapiens; identical to SEQ ID NO: 535385
  misc_feature: HIJSMM301B8E5T.19.71.G05.1.454.light.4.raw

SEQ ID NO: 592705 - DNA, 502 bp, Homo sapiens
  misc_feature: HIJSMM301CR1S1.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtctatctcttatgtcttcggaactgggaccaaggtcaccgtcctaggtcagcccaaggccaaccccatgtca

SEQ ID NO: 592706 - DNA, 462 bp, Homo sapiens
  misc_feature: HIJSMM301A1P5M.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttccgccatctgacactactatg

SEQ ID NO: 592707 - DNA, 496 bp, Homo sapiens; identical to SEQ ID NO: 535109
  misc_feature: HIJSMM301CORTF.16.78.H01.1.454.light.4.raw

SEQ ID NO: 592708 - DNA, 502 bp, Homo sapiens; identical to SEQ ID NO: 544940
  misc_feature: HIJSMM301EFIO6.9.53.E09.1.454.light.4.raw

SEQ ID NO: 592709 - DNA, 445 bp, Homo sapiens; identical to SEQ ID NO: 537719
  misc_feature: HIJSMM301A6R51.47.85.H08.1.454.light.4.raw

SEQ ID NO: 592710 - DNA, 491 bp, Homo sapiens
  misc_feature: HIJSMM301CDN0J.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccggttcacttttggccaggggaccaaactggatatcagacgaactgtggctgca

SEQ ID NO: 592711 - DNA, 494 bp, Homo sapiens; identical to SEQ ID NO: 540110
  misc_feature: HIJSMM301CHGXR.51.71.G05.1.454.light.4.raw

SEQ ID NO: 592712 - DNA, 506 bp, Homo sapiens
  misc_feature: HIJSMM301DCPHM.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtccccaaacttctgatttatgatgtcactaagcggccctcaggggtcgctgatcgcttctctggttccaagtctggcgacacggcctccctgaccatctctgggctccagactgaggatgaggctacttattttgctgctcttatgcaggctagttcgctctcgaagtgttcggcggagggaccgagctgaccgtcctacgtcacgcccaggctcgtccccccg

SEQ ID NO: 592713 - DNA, 509 bp, Homo sapiens
  misc_feature: HIJSMM301DG55N.7.87.H10.1.454.light.4.raw
  modified_base (460)..(460): a, c, t, g, unknown or other
  modified_base (476)..(476): a, c, t, g, unknown or other
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcaggaccgaagtacggaagtanaaacgaactagtaggntgcacaactctgtcttctactcttcccgccact

SEQ ID NO: 592714 - DNA, 513 bp, Homo sapiens; identical to SEQ ID NO: 565259
  misc_feature: HIJSMM301CMTLZ.17.33.C11.1.454.light.4.raw

SEQ ID NO: 592715 - DNA, 444 bp, Homo sapiens
  misc_feature: HIJSMM301DPWHP.8.11.A11.1.454.light.4.raw
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggtgggaccaaggtgaccgtcctgagtcagcccaaggctgcccccacggtcactctgttcccaccctcctcgacacgcgag

SEQ ID NO: 592716 - DNA, 447 bp, Homo sapiens; identical to SEQ ID NO: 535201
  misc_feature: HIJSMM301B6YYX.18.9.A09.1.454.light.4.raw

SEQ ID NO: 592717 - DNA, 501 bp, Homo sapiens
  misc_feature: HIJSMM301C0J59.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctcaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccc

SEQ ID NO: 592718 - DNA, 511 bp, Homo sapiens
  misc_feature: HIJSMM301D62UT.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgagggcgatcagcggccctcaggggtttctgatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcact

SEQ ID NO: 592719 - DNA, 492 bp, Homo sapiens; identical to SEQ ID NO: 556285
  misc_feature: HIJSMM301EZTDJ.53.4.A04.1.454.light.4.raw

SEQ ID NO: 592720 - DNA, 492 bp, Homo sapiens
  misc_feature: HIJSMM301DF5X4.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcacc

SEQ ID NO: 592721 - DNA, 492 bp, Homo sapiens
  misc_feature: HIJSMM301CZQHG.13.76.G10.1.454.light.4.raw
  modified_base (428)..(428): a, c, t, g, unknown or other
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccacggctatggagtgaggctgactattaactgtcagcggtgggacgaggcagcactncccggcctactgtcgttcgtaacgtacggacggaacggacgaccgtcctaacgtactagacccg

SEQ ID NO: 592722 - DNA, 523 bp, Homo sapiens
  misc_feature: HIJSMM301BAMKT.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtcggccgtccgggggcctactttccggcccgtcgggaaccaaacggtaggatatacaaaccgaactggtggcgtcgcaccactcttcgtctt

SEQ ID NO: 592723 - DNA, 451 bp, Homo sapiens
  misc_feature: HIJSMM301AK23Q.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgccctcctcacgcgtatgt

SEQ ID NO: 592724 - DNA, 487 bp, Homo sapiens
  misc_feature: HIJSMM301AKAT4.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccact

SEQ ID NO: 592725 - DNA, 504 bp, Homo sapiens; identical to SEQ ID NO: 547223
  misc_feature: HIJSMM301COHMY.18.37.D04.1.454.light.4.raw

SEQ ID NO: 592726 - DNA, 492 bp, Homo sapiens
  misc_feature: HIJSMM301AL3CL.26.53.E09.1.454.light.4.raw
agactatactcacgaccggtgctcgatttagagagagtgtgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgctaatttattactgtcagcaatataatacctggcctccgctcactttcggcggagggaccgaaggttgagatacaaacgaactgtggctgcaccta

SEQ ID NO: 592727 - DNA, 499 bp, Homo sapiens; identical to SEQ ID NO: 575204
  misc_feature: HIJSMM301CR35Z.5.24.C02.1.454.light.4.raw

SEQ ID NO: 592728 - DNA, 478 bp, Homo sapiens; identical to SEQ ID NO: 561143
  misc_feature: HIJSMM301ENJTJ.41.68.G02.1.454.light.4.raw

SEQ ID NO: 592729 - DNA, 503 bp, Homo sapiens
  misc_feature: HIJSMM301DIZRO.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcaggtgggtctgggacagacttcactctcaccatcagcgacctagagcctgaagattttgcagtttattactgtcagcagcgtagcatctggcctccgtaccacctttggccaggggaccaagctggagatacaaacgaactgtggctgcaccatctgtcttcatt

SEQ ID NO: 592730 - DNA, 486 bp, Homo sapiens; identical to SEQ ID NO: 546042
  misc_feature: HIJSMM301EENT8.14.53.E09.1.454.light.4.raw

SEQ ID NO: 592731 - DNA, 520 bp, Homo sapiens; identical to SEQ ID NO: 537173
  misc_feature: HIJSMM301EGEDP.27.23.C01.1.454.light.4.raw

SEQ ID NO: 592732 - DNA, 486 bp, Homo sapiens; identical to SEQ ID NO: 535043
  misc_feature: HIJSMM301ED0YH.46.35.D02.1.454.light.4.raw

SEQ ID NO: 592733 - DNA, 486 bp, Homo sapiens
  misc_feature: HIJSMM301CULWH.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccgagggaccaagctggagatcaaacgaactgtggctgcaccat

SEQ ID NO: 592734 - DNA, 473 bp, Homo sapiens
  misc_feature: HIJSMM301A3V2N.51.78.H01.1.454.light.4.raw
cgatcgtatacacgaccggtgctcgatttagtgtgagtagtttgggtttgggggtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttcaccatcagcaggctgcagcctgaagacattgcaacatattactgtcaacagtatgatagtctccgctcactttcggcgggggaccgaaggtggagatcaagcgaactgtgg

SEQ ID NO: 592735 - DNA, 521 bp, Homo sapiens; identical to SEQ ID NO: 538715
  misc_feature: HIJSMM301C8JLD.27.23.C01.1.454.light.4.raw

SEQ ID NO: 592736 - DNA, 457 bp, Homo sapiens; identical to SEQ ID NO: 536586
  misc_feature: HIJSMM301A543Y.49.85.H08.1.454.light.4.raw

SEQ ID NO: 592737 - DNA, 466 bp, Homo sapiens; identical to SEQ ID NO: 546958
  misc_feature: HIJSMM301B9O7F.11.70.G04.1.454.light.4.raw

SEQ ID NO: 592738 - DNA, 498 bp, Homo sapiens
  misc_feature: HIJSMM301AKQ3J.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggagagtcaaacgaactagtggc

SEQ ID NO: 592739 - DNA, 504 bp, Homo sapiens
  misc_feature: HIJSMM301A5GDW.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtgaggctgaggatgttggggttattactgcatgcaaactacacacggccgctcactttcggcggagggaccaaggtggagatcaaacgaactgtggctgcaccatctgtt

SEQ ID NO: 592740 - DNA, 509 bp, Homo sapiens; identical to SEQ ID NO: 536047
  misc_feature: HIJSMM301BG9OD.17.33.C11.1.454.light.4.raw

SEQ ID NO: 592741 - DNA, 518 bp, Homo sapiens; identical to SEQ ID NO: 536231
  misc_feature: HIJSMM301BXHSC.22.30.C08.1.454.light.4.raw

SEQ ID NO: 592742 - DNA, 491 bp, Homo sapiens; identical to SEQ ID NO: 535294
  misc_feature: HIJSMM301CGQMK.16.68.G02.1.454.light.4.raw

SEQ ID NO: 592743 - DNA, 492 bp, Homo sapiens
  misc_feature: HIJSMM301EBU5P.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaactttactactgtcaacagacttacagtcgccccccgatcaccttcggccaagggacacgactggagattaaacgaactgtggctgcaccatctgtcttcatt

SEQ ID NO: 592744 - DNA, 500 bp, Homo sapiens
  misc_feature: HIJSMM301D33VL.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccgaggggaccgaacggtaggaaagtacaaacgaaacctagtgggctggcaccta

SEQ ID NO: 592745 - DNA, 504 bp, Homo sapiens; identical to SEQ ID NO: 536385
  misc_feature: HIJSMM301BOG49.27.78.H01.1.454.light.4.raw

SEQ ID NO: 592746 - DNA, 481 bp, Homo sapiens; identical to SEQ ID NO: 535993
  misc_feature: HIJSMM301AMOTM.21.25.C03.1.454.light.4.raw

SEQ ID NO: 592747 - DNA, 470 bp, Homo sapiens; identical to SEQ ID NO: 547523
  misc_feature: HIJSMM301CNG59.5.28.C06.1.454.light.4.raw

SEQ ID NO: 592748 - DNA, 494 bp, Homo sapiens; identical to SEQ ID NO: 534994
  misc_feature: HIJSMM301EYFHY.27.78.H01.1.454.light.4.raw

SEQ ID NO: 592749 - DNA, 495 bp, Homo sapiens; identical to SEQ ID NO: 535821
  misc_feature: HIJSMM301EXEMM.3.31.C09.1.454.light.4.raw

SEQ ID NO: 592750 - DNA, 494 bp, Homo sapiens; identical to SEQ ID NO: 534992
  misc_feature: HIJSMM301CB83V.9.1.A01.1.454.light.4.raw

SEQ ID NO: 592751 - DNA, 502 bp, Homo sapiens
  misc_feature: HIJSMM301CD7PM.48.28.C06.1.454.light.4.raw
agtatacatacacgaccggtgctcgatttagagctcacgtattgggtttggggggggtcgacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccccg

SEQ ID NO: 592752 - DNA, 496 bp, Homo sapiens; identical to SEQ ID NO: 536802
  misc_feature: HIJSMM301EYCP1.5.24.C02.1.454.light.4.raw

SEQ ID NO: 592753 - DNA, 475 bp, Homo sapiens; identical to SEQ ID NO: 550613
  misc_feature: HIJSMM301ENKTZ.43.76.G10.1.454.light.4.raw

SEQ ID NO: 592754 - DNA, 525 bp, Homo sapiens
  misc_feature: HIJSMM301BY4L7.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcacccccctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggcctgccccctcggtcactctgttcccaccctcct

SEQ ID NO: 592755 - DNA, 519 bp, Homo sapiens
  misc_feature: HIJSMM301EPBBB.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccaatggttgcaccgcaaagcgggacccagaccctggagcctcagttggaagcagccgatccagcctgcggagcctgtggggcaggtcagcccaaggcctgccccctcggtccactctcgttcccaccctcctccacg

SEQ ID NO: 592756 - DNA, 502 bp, Homo sapiens; identical to SEQ ID NO: 558683
  misc_feature: HIJSMM301DVJRB.4.71.G05.1.454.light.4.raw

SEQ ID NO: 592757 - DNA, 487 bp, Homo sapiens
  misc_feature: HIJSMM301CUUGH.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggccaagggaccaaggtggaaatcaaacgaactgtgctgcacat

SEQ ID NO: 592758 - DNA, 490 bp, Homo sapiens
  misc_feature: HIJSMM301DHK06.16.68.G02.1.454.light.4.raw
tgtactactccacgaccggtgctcgatttagtcgatagtgaagggaaagggggagtcaggcccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcat

SEQ ID NO: 592759 - DNA, 501 bp, Homo sapiens
  misc_feature: HIJSMM301DYVRN.49.41.D08.1.454.light.4.raw
agtcgagagacacgaccggtgctcgatttagtcacgcgagaaagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgcttcatatggcaggcaacttcgcttttgtcttcggaactgggaccgaggtcaccgtcctgggtcagcccaaggccaacccc

SEQ ID NO: 592760 - DNA, 493 bp, Homo sapiens
  misc_feature: HIJSMM301BJAUU.53.81.H04.1.454.light.4.raw
cgcgtatacacacgaccggtgctcgatttagtagtgtagattcgcggggcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagccctccctggccatcagtggcctccggtccgacgatgaggctgattattattgtgcagcatgggatgacagcctgagtggtgtggtattcggcggagggaccaagctgaccgtcctaggtcagccc

SEQ ID NO: 592761 - DNA, 517 bp, Homo sapiens; identical to SEQ ID NO: 548112
  misc_feature: HIJSMM301CWMVK.3.87.H10.1.454.light.4.raw

SEQ ID NO: 592762 - DNA, 504 bp, Homo sapiens
  misc_feature: HIJSMM301CXTD0.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcactcttcccg

SEQ ID NO: 592763 - DNA, 463 bp, Homo sapiens
  misc_feature: HIJSMM301EYOT8.52.2.A02.1.454.light.4.raw
  modified_base (418)..(418): a, c, t, g, unknown or other
cgcagtacgacacgaccggtgctcgatttagactcatctacaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttacttcaccatcgccagactgcagcctgaagatattgcaacatattactgtcaacagtatgataatntcccgctcactttcggcggagggaccaaggtggagatcagacgaa

SEQ ID NO: 592764 - DNA, 503 bp, Homo sapiens
  misc_feature: HIJSMM301D6DJ5.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccgggtccgaggatgaggctgactattactgtgcatcacgggacgcaacatgggatgacaatctgagcggttgggtgttcggcggagggaccaaactgaccgtcctaggtcagcccaa

SEQ ID NO: 592765 - DNA, 513 bp, Homo sapiens
  misc_feature: HIJSMM301B7UNP.15.76.G10.1.454.light.4.raw
  modified_base (486)..(486): a, c, t, g, unknown or other
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctggacccctgcccgattctcaggctccctccttggggcaaagctgccctgacactgtctggtgtgcagcctgaggagaggctgactattactgcctactctactttggtgtgctgtgctattcggcggagggaccaagctgaccgtcttaagtcagcccaaggctcgccccctcggtcnctctcgttcccaccctcctcgctaacg

SEQ ID NO: 592766 - DNA, 447 bp, Homo sapiens; identical to SEQ ID NO: 535201
  misc_feature: HIJSMM301B1PRI.18.9.A09.1.454.light.4.raw

SEQ ID NO: 592767 - DNA, 498 bp, Homo sapiens
  misc_feature: HIJSMM301DGB3O.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcagcactgttttggcggttctccgacttcggcggagggaccgaaggtggaggtcgaaacgaacctagtggcgtgcaccat

SEQ ID NO: 592768 - DNA, 502 bp, Homo sapiens
  misc_feature: HIJSMM301AJ1J3.40.67.G01.1.454.light.4.raw
tctagcgactcacgaccggtgctcgatttagagtatacatattgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 592769 - DNA, 472 bp, Homo sapiens
  misc_feature: HIJSMM301DNLMQ.49.82.H05.1.454.light.4.raw
agtcgagagacacgaccggtgctcgatttagtcgagctctctcgcgggcacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatagtctcccgctcactttc

SEQ ID NO: 592770 - DNA, 447 bp, Homo sapiens; identical to SEQ ID NO: 535201
  misc_feature: HIJSMM301DIRFX.18.9.A09.1.454.light.4.raw

SEQ ID NO: 592771 - DNA, 485 bp, Homo sapiens
  misc_feature: HIJSMM301DKV0B.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaaggtggaactcaaacgaaactgtggctgcaccatctgtcttcatcttcccgccatctgactagtcacg

SEQ ID NO: 592772 - DNA, 473 bp, Homo sapiens; identical to SEQ ID NO: 536488
  misc_feature: HIJSMM301AP0IG.12.49.E05.1.454.light.4.raw

SEQ ID NO: 592773 - DNA, 488 bp, Homo sapiens; identical to SEQ ID NO: 540342
  misc_feature: HIJSMM301DDLEZ.43.33.C11.1.454.light.4.raw

SEQ ID NO: 592774 - DNA, 501 bp, Homo sapiens
  misc_feature: HIJSMM301AIHUM.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcgggcggagggactaagctgaccgtcctaagtcagcccaac

SEQ ID NO: 592775 - DNA, 491 bp, Homo sapiens; identical to SEQ ID NO: 535294
  misc_feature: HIJSMM301EBFV8.16.68.G02.1.454.light.4.raw

SEQ ID NO: 592776 - DNA, 501 bp, Homo sapiens
  misc_feature: HIJSMM301D9GXT.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaaggtcacccgtcctgggtcagccccaaggccaaccccactgtcactcttccg

SEQ ID NO: 592777 - DNA, 513 bp, Homo sapiens
  misc_feature: HIJSMM301BC6X5.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaattatcatttctgctgtcagtaatcggccctcaggggtttctagtcgcttctctggctccaagtctggcaacacggccccctgaccatctctgggctccaggctgaggacgaggctgattattattgcagctcatatacaaacaccaaagactttgatattcggcggagggaccaaactgaccgtccttcgtcagcccaacgctgccccctccgtcactctgttcccaccct

SEQ ID NO: 592778 - DNA, 481 bp, Homo sapiens
  misc_feature: HIJSMM301AFZUX.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaagctgaccgtcctaagtcagaccccg

SEQ ID NO: 592779 - DNA, 494 bp, Homo sapiens; identical to SEQ ID NO: 534994
  misc_feature: HIJSMM301BUVEX.27.78.H01.1.454.light.4.raw

SEQ ID NO: 592780 - DNA, 454 bp, Homo sapiens; identical to SEQ ID NO: 536943
  misc_feature: HIJSMM301B8SBQ.19.86.H09.1.454.light.4.raw

SEQ ID NO: 592781 - DNA, 494 bp, Homo sapiens; identical to SEQ ID NO: 534992
  misc_feature: HIJSMM301EGLV7.9.1.A01.1.454.light.4.raw

SEQ ID NO: 592782 - DNA, 484 bp, Homo sapiens; identical to SEQ ID NO: 536570
  misc_feature: HIJSMM301BD244.46.35.D02.1.454.light.4.raw

SEQ ID NO: 592783 - DNA, 447 bp, Homo sapiens
  misc_feature: HIJSMM301DDJ0Q.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcatgatttatgatgtcagtaatcggccctcaggggtttctaatcgcttctctggctccaagtctggcaacacggcctccctgaccatctctgggctccaggctgaggacgaggctgattattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 592784 - DNA, 501 bp, Homo sapiens
  misc_feature: HIJSMM301B6FJZ.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcgagggaccaaactgaccgtcctaggtcagcccaaggctgcccctcc

SEQ ID NO: 592785 - DNA, 495 bp, Homo sapiens; identical to SEQ ID NO: 543094
  misc_feature: HIJSMM301EY672.22.57.F02.1.454.light.4.raw

SEQ ID NO: 592786 - DNA, 504 bp, Homo sapiens
  misc_feature: HIJSMM301B8R88.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgcacggacgacggtaggaagtacaacgaactagtagcgtgcaccactctgtcttcctatcttccccg

SEQ ID NO: 592787 - DNA, 496 bp, Homo sapiens; identical to SEQ ID NO: 535541
  misc_feature: HIJSMM301D23QG.3.33.C11.1.454.light.4.raw

SEQ ID NO: 592788 - DNA, 498 bp, Homo sapiens
  misc_feature: HIJSMM301CNWTH.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacttcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcacc

SEQ ID NO: 592789 - DNA, 493 bp, Homo sapiens; identical to SEQ ID NO: 535084
  misc_feature: HIJSMM301B6WH0.47.64.F09.1.454.light.4.raw

SEQ ID NO: 592790 - DNA, 475 bp, Homo sapiens
  misc_feature: HIJSMM301EOAQ1.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcaccttttttaaattggtatcaacagagcccaggaaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 592791 - DNA, 499 bp, Homo sapiens; identical to SEQ ID NO: 536578
  misc_feature: HIJSMM301BJ5M2.22.27.C05.1.454.light.4.raw

SEQ ID NO: 592792 - DNA, 499 bp, Homo sapiens
  misc_feature: HIJSMM301DHY9C.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtccactctccg

SEQ ID NO: 592793 - DNA, 486 bp, Homo sapiens; identical to SEQ ID NO: 537792
  misc_feature: HIJSMM301DI6DC.46.26.C04.1.454.light.4.raw

SEQ ID NO: 592794 - DNA, 478 bp, Homo sapiens
  misc_feature: HIJSMM301DBUHC.51.44.D11.1.454.light.4.raw
cgatcgtatacacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaattgccgggcaagtcagagcattagctaggtatttaaattggtatcagcagaaaccagggaaagcccctaaggtcctgatctatgctgcatccagtttgcaaagtggggtcccatcaaggttcagtggcagtggatctgggacggatttcactctcaccatcagcagtctgcaacttgcagattctgcaacttactattgtcaacagagtttcaattcccctcgcacgttcggccaagggaccaaggtggaaatcaaacgaactgtggctgcaccat

SEQ ID NO: 592795 - DNA, 521 bp, Homo sapiens
  misc_feature: HIJSMM301AX4WD.13.33.C11.1.454.light.4.raw
tcacgtactacacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgtatttttactgttgttcatatgcaggaaggagtgattatgtctttggaagtgggaccaaggtcaccgtccttggtcagcccaaggcccaaccccactgtcactctgttcccccg

SEQ ID NO: 592796 - DNA, 488 bp, Homo sapiens
  misc_feature: HIJSMM301AKTO5.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccgagggaccaagctggagatcaggcgtaacg

SEQ ID NO: 592797 - DNA, 484 bp, Homo sapiens
  misc_feature: HIJSMM301CFW9O.52.22.B11.1.454.light.4.raw
cgcagtacgacacgaccggtgctcgatttagacgacagctcaggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtt

SEQ ID NO: 592798 - DNA, 495 bp, Homo sapiens; identical to SEQ ID NO: 546081
  misc_feature: HIJSMM301AO57C.13.46.E02.1.454.light.4.raw

SEQ ID NO: 592799 - DNA, 486 bp, Homo sapiens; identical to SEQ ID NO: 535043
  misc_feature: HIJSMM301AYYWA.46.35.D02.1.454.light.4.raw

SEQ ID NO: 592800 - DNA, 510 bp, Homo sapiens
  misc_feature: HIJSMM301BBK3K.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgccaggacgaaggtggaagtacaacgaactagtaggctgcaccatctgtcttctactcttcccgtccactctgat

SEQ ID NO: 592801 - DNA, 507 bp, Homo sapiens
  misc_feature: HIJSMM301BQMRL.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcgggttgggtgttcgggcggagggaccaaactcggaccgtcctaggtcagcccaa

SEQ ID NO: 592802 - DNA, 496 bp, Homo sapiens; identical to SEQ ID NO: 563961
  misc_feature: HIJSMM301BMSMZ.15.81.H04.1.454.light.4.raw

SEQ ID NO: 592803 - DNA, 444 bp, Homo sapiens
  misc_feature: HIJSMM301EUZ4J.10.76.G10.1.454.light.4.raw
catagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctccactactatg

SEQ ID NO: 592804 - DNA, 495 bp, Homo sapiens; identical to SEQ ID NO: 539326
  misc_feature: HIJSMM301C8PLA.52.86.H09.1.454.light.4.raw

SEQ ID NO: 592805 - DNA, 484 bp, Homo sapiens; identical to SEQ ID NO: 535400
  misc_feature: HIJSMM301C8ALQ.46.26.C04.1.454.light.4.raw

SEQ ID NO: 592806 - DNA, 484 bp, Homo sapiens
  misc_feature: HIJSMM301DUZBQ.40.15.B04.1.454.light.4.raw
tctagcgactcacgaccggtgctcgatttagacagtatatatccgcgggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattattgctcagcatgggacaccagcctcaatgccgcggtattcggcgcagggaccaagctgaccgtcctaggtcagccccg

SEQ ID NO: 592807 - DNA, 447 bp, Homo sapiens; identical to SEQ ID NO: 535020
  misc_feature: HIJSMM301BQK6P.18.9.A09.1.454.light.4.raw

SEQ ID NO: 592808 - DNA, 478 bp, Homo sapiens
  misc_feature: HIJSMM301EVR31.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcactcagcctccctggtcatcgctgggctccaggctgacgatgaggctgattattattgccagtcctatgacaacaccctgcgtggttttggctgttcggcggcggacc

SEQ ID NO: 592809 - DNA, 444 bp, Homo sapiens; identical to SEQ ID NO: 535594
  misc_feature: HIJSMM301EGUV1.9.9.A09.1.454.light.4.raw

SEQ ID NO: 592810 - DNA, 505 bp, Homo sapiens
  misc_feature: HIJSMM301DGUCZ.48.30.C08.1.454.light.4.raw
agtatacatacacgaccggtgctcgatttagtctgacgtcaaagggaaaggggggggaggaactgctcagttaggacccagacggaaccatggaagccccagcgcagcttctcttcctcctgctactctggctcccagatgtcactggagaaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggaactgtggctgcaccatctgtctt

SEQ ID NO: 592811 - DNA, 492 bp, Homo sapiens
  misc_feature: HIJSMM301A7XIC.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtccgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgctaacttattactgtcaacagagtttcagtacgcggacgttcggccgaacggaccgaacggtaggaagtacaaacgaactagtggctgcaccta

SEQ ID NO: 592812 - DNA, 510 bp, Homo sapiens
  misc_feature: HIJSMM301CQ17T.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcactctgttccccg

SEQ ID NO: 592813 - DNA, 506 bp, Homo sapiens; identical to SEQ ID NO: 554189
  misc_feature: HIJSMM301CKO7T.19.78.H01.1.454.light.4.raw

SEQ ID NO: 592814 - DNA, 482 bp, Homo sapiens; identical to SEQ ID NO: 535216
  misc_feature: HIJSMM301CC0C0.17.26.C04.1.454.light.4.raw

SEQ ID NO: 592815 - DNA, 480 bp, Homo sapiens
  misc_feature: HIJSMM301A2ZAF.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaa

SEQ ID NO: 592816 - DNA, 482 bp, Homo sapiens
  misc_feature: HIJSMM301DR1E8.51.51.E07.1.454.light.4.raw
cgatcgtatacacgaccggtgctcgatttagcatactctacaacacacaaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagaatcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaggatctcccactcactttcggcggagggaccaaggtggagatcagacgaactgtggctgca

SEQ ID NO: 592817 - DNA, 485 bp, Homo sapiens; identical to SEQ ID NO: 546273
  misc_feature: HIJSMM301BD7SY.43.36.D03.1.454.light.4.raw

SEQ ID NO: 592818 - DNA, 447 bp, Homo sapiens; identical to SEQ ID NO: 535020
  misc_feature: HIJSMM301D649A.18.9.A09.1.454.light.4.raw

SEQ ID NO: 592819 - DNA, 503 bp, Homo sapiens
  misc_feature: HIJSMM301AFVKK.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgacgtcctgagtcagcccaaggctgccccccg

SEQ ID NO: 592820 - DNA, 488 bp, Homo sapiens
  misc_feature: HIJSMM301EYYVE.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcccgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccaac

SEQ ID NO: 592821 - DNA, 489 bp, Homo sapiens
  misc_feature: HIJSMM301EFM18.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaccccctaagctcctgatctatggtgcatccactttggaaagtggggtcccctcaaggttcagcggcagtggatctgggacagatttcactctcgccatcagcagcctgcagactgaagattttgctaacttattttgtcaacaggctaacactttccccctcactttcggcggagggaccaaggtggagatcaagcgaactgtggctgcacatctgtctt

SEQ ID NO: 592822 - DNA, 488 bp, Homo sapiens
  misc_feature: HIJSMM301AHQ3K.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccacaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagaccccg

SEQ ID NO: 592823 - DNA, 487 bp, Homo sapiens; identical to SEQ ID NO: 537573
  misc_feature: HIJSMM301DXHJX.3.10.A10.1.454.light.4.raw

SEQ ID NO: 592824 - DNA, 500 bp, Homo sapiens
  misc_feature: HIJSMM301CD1NB.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttattactgcatgcaagctctacaaactcgaacgttcggccaagggaccaaggtggaaatcaaacgaactgtggctgcaccatctgtt

SEQ ID NO: 592825 - DNA, 506 bp, Homo sapiens
  misc_feature: HIJSMM301CVC7D.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactcttcg

SEQ ID NO: 592826 - DNA, 485 bp, Homo sapiens
  misc_feature: HIJSMM301D77AL.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaacgaactgtggctgcacca

SEQ ID NO: 592827 - DNA, 492 bp, Homo sapiens
  misc_feature: HIJSMM301D0OVI.43.29.C07.1.454.light.4.raw
tgtgagtagtcacgaccggtgctcgatttagagtgctacgaagggaaaggggacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactgtggctgcaccatctgtcttcatcttcccgccatctgaacta

SEQ ID NO: 592828 - DNA, 506 bp, Homo sapiens
  misc_feature: HIJSMM301C7K3I.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacgccaccctgaccatcagcagggtcgaagccggggatgaggccgactattactgtcaggtgtgggctggtgataatgatcatgcgggggtgttcggcggagggaccaagctgaccgtcctaagtcagccaaggctgccccctcggtcactctcg

SEQ ID NO: 592829 - DNA, 495 bp, Homo sapiens
  misc_feature: HIJSMM301EFWR5.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccgaggggaccaagctagaaatacaaacgaactgtggctgcaccatctgtctt

SEQ ID NO: 592830 - DNA, 503 bp, Homo sapiens
  misc_feature: HIJSMM301E2V6S.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccatgtcta

SEQ ID NO: 592831 - DNA, 497 bp, Homo sapiens; identical to SEQ ID NO: 536376
  misc_feature: HIJSMM301DHP6P.22.9.A09.1.454.light.4.raw

SEQ ID NO: 592832 - DNA, 506 bp, Homo sapiens
  misc_feature: HIJSMM301DXBIZ.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaaggccaaccccactgtca

SEQ ID NO: 592833 - DNA, 480 bp, Homo sapiens
  misc_feature: HIJSMM301CMTVK.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcggagggaccg

SEQ ID NO: 592834 - DNA, 489 bp, Homo sapiens; identical to SEQ ID NO: 535139
  misc_feature: HIJSMM301CJIX8.14.55.E11.1.454.light.4.raw

SEQ ID NO: 592835 - DNA, 496 bp, Homo sapiens; identical to SEQ ID NO: 535541
  misc_feature: HIJSMM301DXMN4.3.33.C11.1.454.light.4.raw

SEQ ID NO: 592836 - DNA, 495 bp, Homo sapiens; identical to SEQ ID NO: 557386
  misc_feature: HIJSMM301BHV6P.27.78.H01.1.454.light.4.raw

SEQ ID NO: 592837 - DNA, 494 bp, Homo sapiens
  misc_feature: HIJSMM301B6DWW.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaacgaaactgtggctgcaccatctgtcttcatcttcccgt

SEQ ID NO: 592838 - DNA, 491 bp, Homo sapiens; identical to SEQ ID NO: 536549
  misc_feature: HIJSMM301EMFFQ.47.55.E11.1.454.light.4.raw

SEQ ID NO: 592839 - DNA, 493 bp, Homo sapiens; identical to SEQ ID NO: 535047
  misc_feature: HIJSMM301BM661.16.53.E09.1.454.light.4.raw

SEQ ID NO: 592840 - DNA, 506 bp, Homo sapiens; identical to SEQ ID NO: 534969
  misc_feature: HIJSMM301B1I38.18.37.D04.1.454.light.4.raw

SEQ ID NO: 592841 - DNA, 499 bp, Homo sapiens
  misc_feature: HIJSMM301BZBQW.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggtccaagggaccgaacggtggaagtcaaacgaactagtggctgcaccatctgtcttcatcttcccgt

SEQ ID NO: 592842 - DNA, 522 bp, Homo sapiens
  misc_feature: HIJSMM301B2M4H.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctcgccccctcggtccactctgttcccaccct

SEQ ID NO: 592843 - DNA, 303 bp, Homo sapiens
  misc_feature: HIJSMM301CZ1JS.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggaactgtggctgtcaccagtctgtcttcatcttcccgcatctgatagtacgtga

SEQ ID NO: 592844 - DNA, 487 bp, Homo sapiens; identical to SEQ ID NO: 547557
  misc_feature: HIJSMM301CF8JM.7.75.G09.1.454.light.4.raw

SEQ ID NO: 592845 - DNA, 503 bp, Homo sapiens
  misc_feature: HIJSMM301A4L3Y.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggccaaggtggccgtcctaggtcagcccaaggctgccccctcggtcact

SEQ ID NO: 592846 - DNA, 503 bp, Homo sapiens
  misc_feature: HIJSMM301BJRO5.48.36.D03.1.454.light.4.raw
agtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcacacggcctccctgaccatctctgggctccaggctgaagatcaggctgattattactgctgttcattttctaagtttcctttttgttcttcggaacttgggaccgaggtcaccgtcctaggtcagcccaaggccaacccactgt

SEQ ID NO: 592847 - DNA, 521 bp, Homo sapiens
  misc_feature: HIJSMM301CG2YG.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttccccgccctcct

SEQ ID NO: 592848 - DNA, 510 bp, Homo sapiens; identical to SEQ ID NO: 538767
  misc_feature: HIJSMM301CPUY2.17.28.C06.1.454.light.4.raw

SEQ ID NO: 592849 - DNA, 515 bp, Homo sapiens
  misc_feature: HIJSMM301DB6W9.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctgccccctcggtcactctgttcccaccctcctcagacgtatcac

SEQ ID NO: 592850 - DNA, 447 bp, Homo sapiens; identical to SEQ ID NO: 535020
  misc_feature: HIJSMM301BT1RH.18.9.A09.1.454.light.4.raw

SEQ ID NO: 592851 - DNA, 485 bp, Homo sapiens; identical to SEQ ID NO: 535985
  misc_feature: HIJSMM301AXOKN.15.1.A01.1.454.light.4.raw

SEQ ID NO: 592852 - DNA, 493 bp, Homo sapiens; identical to SEQ ID NO: 543205
  misc_feature: HIJSMM301A4SKA.51.6.A06.1.454.light.4.raw

SEQ ID NO: 592853 - DNA, 487 bp, Homo sapiens
  misc_feature: HIJSMM301AK4I1.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctggggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 592854 - DNA, 503 bp, Homo sapiens
  misc_feature: HIJSMM301CQLHL.40.46.E02.1.454.light.4.raw
  modified_base (236)..(236): a, c, t, g, unknown or other
tctagcgactcacgaccggtgctcgatttagactcatctacagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatntgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtccactctcg

SEQ ID NO: 592855 - DNA, 506 bp, Homo sapiens
  misc_feature: HIJSMM301CTGZU.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatcaaacgaactgtggctgcaccatctgtcttcta

SEQ ID NO: 592856 - DNA, 505 bp, Homo sapiens; identical to SEQ ID NO: 536254
  misc_feature: HIJSMM301CHK51.7.71.G05.1.454.light.4.raw

SEQ ID NO: 592857 - DNA, 494 bp, Homo sapiens; identical to SEQ ID NO: 535276
  misc_feature: HIJSMM301EO5NI.16.6.A06.1.454.light.4.raw

SEQ ID NO: 592858 - DNA, 489 bp, Homo sapiens
  misc_feature: HIJSMM301AXMHO.51.6.A06.1.454.light.4.raw
cgatcgtatacacgaccggtgctcgatttagatctactgacagggggctgtgggtccaggaggcagaactctgggtgtctcaccatggcctggatccctctactcctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtca

SEQ ID NO: 592859 - DNA, 522 bp, Homo sapiens; identical to SEQ ID NO: 540296
  misc_feature: HIJSMM301ADUT2.5.27.C05.1.454.light.4.raw

SEQ ID NO: 592860 - DNA, 494 bp, Homo sapiens
  misc_feature: HIJSMM301BNOBV.5.48.E04.1.454.light.4.raw
atcagacacgcacgaccggtgctcgatttagagagcgtcacagagagaaggggaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcacttttcggcggagggaccaaggtggagagcagacgaactgtggctggcaccatctgtcttcatcttcccgcc

SEQ ID NO: 592861 - DNA, 495 bp, Homo sapiens; identical to SEQ ID NO: 549785
  misc_feature: HIJSMM301DJTB3.12.38.D05.1.454.light.4.raw

SEQ ID NO: 592862 - DNA, 505 bp, Homo sapiens
  misc_feature: HIJSMM301BY3O8.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagttactactttacctcaagtgatcaccttcggccaagggacacgactggagattaaaacg

SEQ ID NO: 592863 - DNA, 495 bp, Homo sapiens; identical to SEQ ID NO: 538920
  misc_feature: HIJSMM301CLWVP.47.64.F09.1.454.light.4.raw

SEQ ID NO: 592864 - DNA, 489 bp, Homo sapiens
  misc_feature: HIJSMM301D9R79.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggcctaggggaccaagctggagatcaggcgaacg

SEQ ID NO: 592865 - DNA, 490 bp, Homo sapiens; identical to SEQ ID NO: 537951
  misc_feature: HIJSMM301EE3GC.19.57.F02.1.454.light.4.raw

SEQ ID NO: 592866 - DNA, 491 bp, Homo sapiens; identical to SEQ ID NO: 583505
  misc_feature: HIJSMM301D0C5G.49.60.F05.1.454.light.4.raw

SEQ ID NO: 592867 - DNA, 503 bp, Homo sapiens
  misc_feature: HIJSMM301ADNNM.41.16.B05.1.454.light.4.raw
tctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactaggtacactttggtccacgggaccgaagactcgagatcaaacgaaactagtggcgtgcaccaactctgtcttctatcttcccgt

SEQ ID NO: 592868 - DNA, 491 bp, Homo sapiens
  misc_feature: HIJSMM301DV096.13.39.D06.1.454.light.4.raw
  modified_base (432)..(432): a, c, t, g, unknown or other
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatnttatagtactcctccgaggctcactttcggcggagggaccaaggtggagatcaaacgaa

SEQ ID NO: 592869 - DNA, 489 bp, Homo sapiens
  misc_feature: HIJSMM301EY38S.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgtttcggcggagggaccaagctgaccgtcctaggtcagcccaaggct

SEQ ID NO: 592870 - DNA, 504 bp, Homo sapiens; identical to SEQ ID NO: 555616
  misc_feature: HIJSMM301A3HJY.5.86.H09.1.454.light.4.raw

SEQ ID NO: 592871 - DNA, 486 bp, Homo sapiens; identical to SEQ ID NO: 535043
  misc_feature: HIJSMM301B9FYE.46.35.D02.1.454.light.4.raw

SEQ ID NO: 592872 - DNA, 473 bp, Homo sapiens; identical to SEQ ID NO: 544057
  misc_feature: HIJSMM301CV0VE.7.81.H04.1.454.light.4.raw

SEQ ID NO: 592873 - DNA, 506 bp, Homo sapiens; identical to SEQ ID NO: 543046
  misc_feature: HIJSMM301EJR4V.53.71.G05.1.454.light.4.raw

SEQ ID NO: 592874 - DNA, 494 bp, Homo sapiens; identical to SEQ ID NO: 534994
  misc_feature: HIJSMM301B2GW0.27.78.H01.1.454.light.4.raw

SEQ ID NO: 592875 - DNA, 509 bp, Homo sapiens; identical to SEQ ID NO: 543772
  misc_feature: HIJSMM301AJBAT.2.21.B10.1.454.light.4.raw

SEQ ID NO: 592876 - DNA, 497 bp, Homo sapiens; identical to SEQ ID NO: 536376
  misc_feature: HIJSMM301B7FPC.22.9.A09.1.454.light.4.raw

SEQ ID NO: 592877 - DNA, 484 bp, Homo sapiens; identical to SEQ ID NO: 535441
  misc_feature: HIJSMM301CCNG5.26.60.F05.1.454.light.4.raw

SEQ ID NO: 592878 - DNA, 485 bp, Homo sapiens
  misc_feature: HIJSMM301A4297.43.4.A04.1.454.light.4.raw
tgtgagtagtcacgaccggtgctcgatttagagtagtgatcaggggagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggacatcaaacgaactagtggctgcacc

SEQ ID NO: 592879 - DNA, 508 bp, Homo sapiens
  misc_feature: HIJSMM301C0JGV.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgtttcggcggagggaccaagttgaccgtcctaggtcagcccaaggctgccccctcggtcact

SEQ ID NO: 592880 - DNA, 489 bp, Homo sapiens; identical to SEQ ID NO: 535139
  misc_feature: HIJSMM301A3IRX.14.55.E11.1.454.light.4.raw

SEQ ID NO: 592881 - DNA, 499 bp, Homo sapiens
  misc_feature: HIJSMM301ANT4S.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtcccgtgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaa

SEQ ID NO: 592882 - DNA, 506 bp, Homo sapiens; identical to SEQ ID NO: 534969
  misc_feature: HIJSMM301CDE0Q.18.37.D04.1.454.light.4.raw

SEQ ID NO: 592883 - DNA, 500 bp, Homo sapiens
  misc_feature: HIJSMM301EA8KC.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctggggcagatttcactctcaccatcagcagcctgcaggctgaagatgtggcagtttattactgtcagcaatattatactcctcttccgacgttcggccaagggaccaaggtggaaatcaaacgaactgtggctgcaccat

SEQ ID NO: 592884 - DNA, 483 bp, Homo sapiens; identical to SEQ ID NO: 542318
  misc_feature: HIJSMM301BZTE1.13.59.F04.1.454.light.4.raw

SEQ ID NO: 592885 - DNA, 504 bp, Homo sapiens; identical to SEQ ID NO: 538423
  misc_feature: HIJSMM301CB9RC.48.67.G01.1.454.light.4.raw

SEQ ID NO: 592886 - DNA, 525 bp, Homo sapiens
  misc_feature: HIJSMM301CO4TB.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctagaagatattgctagtttactactgtcagcagtatgttacgtccccgtggacgttcggaccgaacgggaccaaggtggcataccaaccgaactgtggctgcaccatctgtcttctatcttccccg

SEQ ID NO: 592887 - DNA, 516 bp, Homo sapiens; identical to SEQ ID NO: 552129
  misc_feature: HIJSMM301EB39Z.27.23.C01.1.454.light.4.raw

SEQ ID NO: 592888 - DNA, 490 bp, Homo sapiens; identical to SEQ ID NO: 540910
  misc_feature: HIJSMM301DXDCG.40.12.B01.1.454.light.4.raw

SEQ ID NO: 592889 - DNA, 484 bp, Homo sapiens; identical to SEQ ID NO: 538094
  misc_feature: HIJSMM301C2Z3K.3.10.A10.1.454.light.4.raw

SEQ ID NO: 592890 - DNA, 504 bp, Homo sapiens; identical to SEQ ID NO: 564613
  misc_feature: HIJSMM301DFYXA.15.86.H09.1.454.light.4.raw

SEQ ID NO: 592891 - DNA, 494 bp, Homo sapiens; identical to SEQ ID NO: 534992
  misc_feature: HIJSMM301AN674.9.1.A01.1.454.light.4.raw

SEQ ID NO: 592892 - DNA, 493 bp, Homo sapiens; identical to SEQ ID NO: 535047
  misc_feature: HIJSMM301AI5PW.16.53.E09.1.454.light.4.raw

SEQ ID NO: 592893 - DNA, 497 bp, Homo sapiens
  misc_feature: HIJSMM301DX0QA.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtaggaaatcaaacgaactgtggctgcaca

SEQ ID NO: 592894 - DNA, 486 bp, Homo sapiens
  misc_feature: HIJSMM301DQLUX.5.23.C01.1.454.light.4.raw
atcagacacgcacgaccggtgctcgatttagtacacgtgattagggattggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcgcggaggaccaaggtgagatcaaacgaactgtggctgcaccatctgtctt

SEQ ID NO: 592895 - DNA, 479 bp, Homo sapiens
  misc_feature: HIJSMM301B9LMU.22.59.F04.1.454.light.4.raw
acatacgcgtcacgaccggtgctcgatttagtacacacacttagggattgggggaggaatgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 592896 - DNA, 514 bp, Homo sapiens; identical to SEQ ID NO: 546238
  misc_feature: HIJSMM301DX9SJ.47.85.H08.1.454.light.4.raw

SEQ ID NO: 592897 - DNA, 497 bp, Homo sapiens; identical to SEQ ID NO: 536072
  misc_feature: HIJSMM301ENGGA.16.78.H01.1.454.light.4.raw

SEQ ID NO: 592898 - DNA, 506 bp, Homo sapiens
  misc_feature: HIJSMM301EOY1Z.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcgt

SEQ ID NO: 592899 - DNA, 522 bp, Homo sapiens
  misc_feature: HIJSMM301DIATL.27.23.C01.1.454.light.4.raw
  modified_base (518)..(518): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtccactctgttcccnccct

SEQ ID NO: 592900 - DNA, 461 bp, Homo sapiens
  misc_feature: HIJSMM301AQPQ2.52.49.E05.1.454.light.4.raw
cgcagtacgacacgaccggtgctcgatttagagcgactagcaacacacaaaggggagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagat

SEQ ID NO: 592901 - DNA, 485 bp, Homo sapiens; identical to SEQ ID NO: 536307
  misc_feature: HIJSMM301CEMCM.46.35.D02.1.454.light.4.raw

SEQ ID NO: 592902 - DNA, 505 bp, Homo sapiens
  misc_feature: HIJSMM301C4LW6.43.86.H09.1.454.light.4.raw
tgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactagtggctgcaccat

SEQ ID NO: 592903 - DNA, 520 bp, Homo sapiens
  misc_feature: HIJSMM301CALKT.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccct

SEQ ID NO: 592904 - DNA, 495 bp, Homo sapiens
  misc_feature: HIJSMM301D233A.4.59.F04.1.454.light.4.raw
agcactgtagcacgaccggtgctcgatttagtacacacacttagggattggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatcaaacgaactgtggctgcaccatctgtctt

SEQ ID NO: 592905 - DNA, 488 bp, Homo sapiens; identical to SEQ ID NO: 535990
  misc_feature: HIJSMM301CANDS.11.28.C06.1.454.light.4.raw

SEQ ID NO: 592906 - DNA, 508 bp, Homo sapiens
  misc_feature: HIJSMM301EOIQ4.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttcncggggcgttcggccaagggaccaacggtggaaatcaaacgaactagtggctgccaccatctgtcttctatcttccccg

SEQ ID NO: 592907 - DNA, 503 bp, Homo sapiens
  misc_feature: HIJSMM301BU9ZD.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggacaaagctgccctcaccatcgcgggggcccaggcagatgatgagtgtgattattactgtgtgctctatatggcagtggcgtttgggtgttcggcggagggaccaagctgaccgtc

SEQ ID NO: 592908 - DNA, 493 bp, Homo sapiens
  misc_feature: HIJSMM301ENKZ9.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaatacctactcttttctcttcggaactgggaccacggtcaccgtcctaggtcagcccaaggccaaccc

SEQ ID NO: 592909 - DNA, 502 bp, Homo sapiens; identical to SEQ ID NO: 557953
  misc_feature: HIJSMM301ERZ4Y.15.57.F02.1.454.light.4.raw

SEQ ID NO: 592910 - DNA, 497 bp, Homo sapiens; identical to SEQ ID NO: 538030
  misc_feature: HIJSMM301D40K7.40.23.C01.1.454.light.4.raw

SEQ ID NO: 592911 - DNA, 508 bp, Homo sapiens
  misc_feature: HIJSMM301A9R1N.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactgggaaagcccctacactcctgatcaatgcagcgtccagtttacagagtggggtcccctcaaggttcagtggcagtggatctgggacagactttactctcaccatcagcgatctgcagcctgacgattttgtcgacttactactgtcaacagagtttccggaaccccgttacctttcggtcggagggaccgaaggtaggagatcaaacgaactagtggctgcaccatcccctgtcttctatcttccccg

SEQ ID NO: 592912 - DNA, 503 bp, Homo sapiens; identical to SEQ ID NO: 543363
  misc_feature: HIJSMM301EEJNW.19.78.H01.1.454.light.4.raw

SEQ ID NO: 592913 - DNA, 502 bp, Homo sapiens; identical to SEQ ID NO: 537363
  misc_feature: HIJSMM301AELRX.18.23.C01.1.454.light.4.raw

SEQ ID NO: 592914 - DNA, 516 bp, Homo sapiens
  misc_feature: HIJSMM301CYGGY.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccacctcctcagtcgct

SEQ ID NO: 592915 - DNA, 502 bp, Homo sapiens
  misc_feature: HIJSMM301C2NB5.53.81.H04.1.454.light.4.raw
cgcgtatacacacgaccggtgctcgatttagtagtgtagattcgcggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgtattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcgggcggagggaccaagctgaccgtcctaggtcagcccaaggcctcc

SEQ ID NO: 592916 - DNA, 487 bp, Homo sapiens
  misc_feature: HIJSMM301B728X.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatacaaacgaactgtggctgcaccatctgt

SEQ ID NO: 592917 - DNA, 492 bp, Homo sapiens
  misc_feature: HIJSMM301D1STX.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactgacatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagcgaactgtggctgcaccatctgtt

SEQ ID NO: 592918 - DNA, 518 bp, Homo sapiens; identical to SEQ ID NO: 579925
  misc_feature: HIJSMM301C9VZF.14.78.H01.1.454.light.4.raw

SEQ ID NO: 592919 - DNA, 447 bp, Homo sapiens; identical to SEQ ID NO: 535201
  misc_feature: HIJSMM301DJ486.18.9.A09.1.454.light.4.raw

SEQ ID NO: 592920 - DNA, 500 bp, Homo sapiens
  misc_feature: HIJSMM301AM13Q.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatattttctatcctcgtggacgttcggccaagggaccagggtggaaatcagacgaactgtggctgccacat

SEQ ID NO: 592921 - DNA, 468 bp, Homo sapiens
  misc_feature: HIJSMM301B4INF.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgttcaacaggctgacagtctccgctcactttcggcgagggaccaaggtggagatcaaacgaa

SEQ ID NO: 592922 - DNA, 525 bp, Homo sapiens
  misc_feature: HIJSMM301CV3I1.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccgaacgggaccgaacggtacggtaaagtactaaagacgaacgtacgtggtcgtgcgaccgaactctgtcttctactcttcccgt

SEQ ID NO: 592923 - DNA, 497 bp, Homo sapiens; identical to SEQ ID NO: 535664
  misc_feature: HIJSMM301BN8IW.22.14.B03.1.454.light.4.raw

SEQ ID NO: 592924 - DNA, 493 bp, Homo sapiens; identical to SEQ ID NO: 537281
  misc_feature: HIJSMM301BYJGI.9.1.A01.1.454.light.4.raw

SEQ ID NO: 592925 - DNA, 497 bp, Homo sapiens
  misc_feature: HIJSMM301DVYL3.12.37.D04.1.454.light.4.raw
atacgacgtacacgaccggtgctcgatttagtagcatactgttgggtttggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtctttca

SEQ ID NO: 592926 - DNA, 482 bp, Homo sapiens; identical to SEQ ID NO: 560945
  misc_feature: HIJSMM301EQ2DJ.13.8.A08.1.454.light.4.raw

SEQ ID NO: 592927 - DNA, 502 bp, Homo sapiens; identical to SEQ ID NO: 541971
  misc_feature: HIJSMM301AECYP.4.39.D06.1.454.light.4.raw

SEQ ID NO: 592928 - DNA, 505 bp, Homo sapiens; identical to SEQ ID NO: 536233
  misc_feature: HIJSMM301AI9KA.48.25.C03.1.454.light.4.raw

SEQ ID NO: 592929 - DNA, 447 bp, Homo sapiens; identical to SEQ ID NO: 535201
  misc_feature: HIJSMM301EOMMI.18.9.A09.1.454.light.4.raw

SEQ ID NO: 592930 - DNA, 510 bp, Homo sapiens
  misc_feature: HIJSMM301CM308.5.58.F03.1.454.light.4.raw
  modified_base (446)..(446): a, c, t, g, unknown or other
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttangttcgggactgggaccaaggtcacgtcctaggtcagcccaaggccaacccactgtcactcttcg

SEQ ID NO: 592931 - DNA, 501 bp, Homo sapiens; identical to SEQ ID NO: 537793
  misc_feature: HIJSMM301BQ5R9.15.37.D04.1.454.light.4.raw

SEQ ID NO: 592932 - DNA, 505 bp, Homo sapiens
  misc_feature: HIJSMM301DKEJ9.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggtcttttcggcggagggaccaagctgaccgtcctgggtcagcccaaggctcgccccctcggt

SEQ ID NO: 592933 - DNA, 466 bp, Homo sapiens
  misc_feature: HIJSMM301AY5W0.11.70.G04.1.454.light.4.raw
  modified_base (392)..(392): a, c, t, g, unknown or other
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagangttgcaacttattactgtcaaaagaatagcgctgccccgctcagtttcggcggagggaccaaggtggagatacg

SEQ ID NO: 592934 - DNA, 483 bp, Homo sapiens; identical to SEQ ID NO: 536665
  misc_feature: HIJSMM301BPCY2.13.59.F04.1.454.light.4.raw

SEQ ID NO: 592935 - DNA, 496 bp, Homo sapiens
  misc_feature: HIJSMM301EN06E.49.80.H03.1.454.light.4.raw
agtcgagagacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccactgtcactc

SEQ ID NO: 592936 - DNA, 509 bp, Homo sapiens; identical to SEQ ID NO: 570166
  misc_feature: HIJSMM301A95DX.47.55.E11.1.454.light.4.raw

SEQ ID NO: 592937 - DNA, 487 bp, Homo sapiens; identical to SEQ ID NO: 538190
  misc_feature: HIJSMM301AJD75.47.70.G04.1.454.light.4.raw

SEQ ID NO: 592938 - DNA, 519 bp, Homo sapiens
  misc_feature: HIJSMM301BHKKO.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaggaccaggctgaccgtcctaggtcagcccaaggctgccccctcggtcactctgttcccaccct

SEQ ID NO: 592939 - DNA, 518 bp, Homo sapiens
  misc_feature: HIJSMM301B1BG8.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccgagggtgaccgtcctaggtcagcccaaggctgccccctcggtcactctgttcccg

SEQ ID NO: 592940 - DNA, 502 bp, Homo sapiens; identical to SEQ ID NO: 536253
  misc_feature: HIJSMM301AGMXH.21.22.B11.1.454.light.4.raw

SEQ ID NO: 592941 - DNA, 447 bp, Homo sapiens; identical to SEQ ID NO: 535020
  misc_feature: HIJSMM301AWD0G.18.9.A09.1.454.light.4.raw

SEQ ID NO: 592942 - DNA, 465 bp, Homo sapiens
  misc_feature: HIJSMM301CBCMC.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaagtggatgtcaccgaa

SEQ ID NO: 592943 - DNA, 481 bp, Homo sapiens; identical to SEQ ID NO: 537819
  misc_feature: HIJSMM301BA47P.22.59.F04.1.454.light.4.raw

SEQ ID NO: 592944 - DNA, 515 bp, Homo sapiens
  misc_feature: HIJSMM301CH237.15.57.F02.1.454.light.4.raw
tctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctcg

SEQ ID NO: 592945 - DNA, 514 bp, Homo sapiens
  misc_feature: HIJSMM301EH7DK.51.27.C05.1.454.light.4.raw
cgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggaggaccaagctgaccgtctaggtcagcccaaggctgccccctcggtcactctgttccccg

SEQ ID NO: 592946 - DNA, 508 bp, Homo sapiens
  misc_feature: HIJSMM301DEX5E.52.53.E09.1.454.light.4.raw
cgcagtacgacacgaccggtgctcgatttagagagagtgtgttgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcgggtggaggctgaggatgttggggttattactgcatgcaaggtacacactggcctccgacgttcggccaagggaccaaggtggaaatcaaacgaactgtggctgcacatctgtcttcta

SEQ ID NO: 592947 - DNA, 488 bp, Homo sapiens; identical to SEQ ID NO: 539612
  misc_feature: HIJSMM301CG0VO.3.55.E11.1.454.light.4.raw

SEQ ID NO: 592948 - DNA, 520 bp, Homo sapiens; identical to SEQ ID NO: 539176
  misc_feature: HIJSMM301CLVD0.27.23.C01.1.454.light.4.raw

SEQ ID NO: 592949 - DNA, 503 bp, Homo sapiens
  misc_feature: HIJSMM301CY88W.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaacgaactgtggctgcaccatctgtcttcta

SEQ ID NO: 592950 - DNA, 509 bp, Homo sapiens; identical to SEQ ID NO: 539359
  misc_feature: HIJSMM301BRRIZ.47.85.H08.1.454.light.4.raw

SEQ ID NO: 592951 - DNA, 495 bp, Homo sapiens; identical to SEQ ID NO: 535596
  misc_feature: HIJSMM301ATRQ1.10.79.H02.1.454.light.4.raw

SEQ ID NO: 592952 - DNA, 485 bp, Homo sapiens; identical to SEQ ID NO: 538954
  misc_feature: HIJSMM301EU1OA.3.55.E11.1.454.light.4.raw

SEQ ID NO: 592953 - DNA, 497 bp, Homo sapiens
  misc_feature: HIJSMM301BCUMJ.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaacgaactgtggctgcaccat

SEQ ID NO: 592954 - DNA, 485 bp, Homo sapiens; identical to SEQ ID NO: 566551
  misc_feature: HIJSMM301ED2W2.53.34.D01.1.454.light.4.raw

SEQ ID NO: 592955 - DNA, 502 bp, Homo sapiens
  misc_feature: HIJSMM301B9JSL.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtgccgtttattactgtcagcaatattatggtactcctccgtggacgttcggccaagggaccaaggtggaaatcaaacgaactgtgctgcaccat

SEQ ID NO: 592956 - DNA, 507 bp, Homo sapiens
  misc_feature: HIJSMM301BHEJD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtggaaagtacaaacgaactagtggcgtgcaccatctgtcttcatcttccccg

SEQ ID NO: 592957 - DNA, 489 bp, Homo sapiens; identical to SEQ ID NO: 535139
  misc_feature: HIJSMM301BKMC8.14.55.E11.1.454.light.4.raw

SEQ ID NO: 592958 - DNA, 492 bp, Homo sapiens
  misc_feature: HIJSMM301CBXHL.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccagggaccgaaggtaggaaatacaaacgaaactgtggctgcaccta

SEQ ID NO: 592959 - DNA, 506 bp, Homo sapiens
  misc_feature: HIJSMM301CKOBB.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactggtggttttcggcggagggaccaaggtgaccgtcctaggtcagcccaaggctgccccctcggtcactctcg

SEQ ID NO: 592960 - DNA, 485 bp, Homo sapiens
  misc_feature: HIJSMM301AXTP0.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcgagggaccaagctgaccgtcctaggtcagcccaaggctgccccctcggtcta

SEQ ID NO: 592961 - DNA, 496 bp, Homo sapiens; identical to SEQ ID NO: 541772
  misc_feature: HIJSMM301BQNEE.51.81.H04.1.454.light.4.raw

SEQ ID NO: 592962 - DNA, 477 bp, Homo sapiens
  misc_feature: HIJSMM301DOX3A.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaacgaactgtggctgcacc

SEQ ID NO: 592963 - DNA, 511 bp, Homo sapiens
  misc_feature: HIJSMM301C0G8N.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaatacagcagggtggaggctgaggagtgttggggtttagttactgcatgcaaactacacacggccgctcactttcggcggagggaccgaaggtaggagatcaaacgaaactgtggctgcaccatctgtt

SEQ ID NO: 592964 - DNA, 447 bp, Homo sapiens; identical to SEQ ID NO: 535201
  misc_feature: HIJSMM301EIXTR.18.9.A09.1.454.light.4.raw

SEQ ID NO: 592965 - DNA, 502 bp, Homo sapiens
  misc_feature: HIJSMM301CNC91.48.86.H09.1.454.light.4.raw
agtatacatacacgaccggtgctcgattagtgctatagacttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 592966 - DNA, 447 bp, Homo sapiens; identical to SEQ ID NO: 535020
  misc_feature: HIJSMM301ETU9Z.18.9.A09.1.454.light.4.raw

SEQ ID NO: 592967 - DNA, 494 bp, Homo sapiens; identical to SEQ ID NO: 551626
  misc_feature: HIJSMM301AN3UY.11.59.F04.1.454.light.4.raw

SEQ ID NO: 592968 - DNA, 499 bp, Homo sapiens; identical to SEQ ID NO: 557233
  misc_feature: HIJSMM301BR0EY.12.18.B07.1.454.light.4.raw

SEQ ID NO: 592969 - DNA, 491 bp, Homo sapiens; identical to SEQ ID NO: 535294
  misc_feature: HIJSMM301EZ6S8.16.68.G02.1.454.light.4.raw

SEQ ID NO: 592970 - DNA, 486 bp, Homo sapiens; identical to SEQ ID NO: 535043
  misc_feature: HIJSMM301BHMCS.46.35.D02.1.454.light.4.raw

SEQ ID NO: 592971 - DNA, 479 bp, Homo sapiens
  misc_feature: HIJSMM301CMESO.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagtatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 592972 - DNA, 497 bp, Homo sapiens
  misc_feature: HIJSMM301D2SO5.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggttttattactgtcagcagtataataactggcctccacggtacacttttggccaggggaccaagctggagatcaaacgaactgtggctgcaccatctgt

SEQ ID NO: 592973 - DNA, 526 bp, Homo sapiens
  misc_feature: HIJSMM301ETM0W.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacaccttgggtgttcggcggagggaccgaggctgaccgtcctaggtcagcccaaggctgccccctcggtcactctgttcccgccctccc

SEQ ID NO: 592974 - DNA, 490 bp, Homo sapiens; identical to SEQ ID NO: 535234
  misc_feature: HIJSMM301BEIZX.17.21.B10.1.454.light.4.raw

SEQ ID NO: 592975 - DNA, 511 bp, Homo sapiens; identical to SEQ ID NO: 546062
  misc_feature: HIJSMM301EP3QC.5.58.F03.1.454.light.4.raw

SEQ ID NO: 592976 - DNA, 479 bp, Homo sapiens
  misc_feature: HIJSMM301BLYB5.40.23.C01.1.454.light.4.raw
tctagcgactcacgaccggtgctcgatttagtacacgtgattagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggaggggaccaagctgaccgtcctaagtcagcccaa

SEQ ID NO: 592977 - DNA, 434 bp, Homo sapiens; identical to SEQ ID NO: 535153
  misc_feature: HIJSMM301D2202.18.5.A05.1.454.light.4.raw

SEQ ID NO: 592978 - DNA, 503 bp, Homo sapiens; identical to SEQ ID NO: 538884
  misc_feature: HIJSMM301C5R2W.27.78.H01.1.454.light.4.raw

SEQ ID NO: 592979 - DNA, 470 bp, Homo sapiens; identical to SEQ ID NO: 587987
  misc_feature: HIJSMM301CJOYQ.49.8.A08.1.454.light.4.raw

SEQ ID NO: 592980 - DNA, 508 bp, Homo sapiens
  misc_feature: HIJSMM301BVWVF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaaggtggaaagtacaaacgaactagtggctgcaccatctgtcttcatcttccccg

SEQ ID NO: 592981 - DNA, 505 bp, Homo sapiens
  misc_feature: HIJSMM301A0C2P.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccggtgggatgacatcctgaatgggtccggtgttcgggcggagggaccaggctgaccgtcctaagtcagcccaaggctg

SEQ ID NO: 592982 - DNA, 499 bp, Homo sapiens
  misc_feature: HIJSMM301AFVY7.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtcccccatgtgatcttcggcggggggaccaagctgaccgtcctaggtcagcccaaggc

SEQ ID NO: 592983 - DNA, 490 bp, Homo sapiens; identical to SEQ ID NO: 535234
  misc_feature: HIJSMM301EY7S0.17.21.B10.1.454.light.4.raw

SEQ ID NO: 592984 - DNA, 492 bp, Homo sapiens
  misc_feature: HIJSMM301B67K0.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccagtctgtcttcatt

SEQ ID NO: 592985 - DNA, 512 bp, Homo sapiens
  misc_feature: HIJSMM301BVLOZ.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtacggaaagtacaagacgaactagtggcgtgcgaccactctgttcttctat

SEQ ID NO: 592986 - DNA, 506 bp, Homo sapiens; identical to SEQ ID NO: 534969
  misc_feature: HIJSMM301DJLN8.18.37.D04.1.454.light.4.raw

SEQ ID NO: 592987 - DNA, 522 bp, Homo sapiens
  misc_feature: HIJSMM301CA6S4.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccaccctcccgagtacgta

SEQ ID NO: 592988 - DNA, 492 bp, Homo sapiens
  misc_feature: HIJSMM301AZXBN.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacaactggccgtacacttttggccaggggaccaaggctggagatcaatcgaactgt

SEQ ID NO: 592989 - DNA, 499 bp, Homo sapiens; identical to SEQ ID NO: 544841
  misc_feature: HIJSMM301DDCY5.19.10.A10.1.454.light.4.raw

SEQ ID NO: 592990 - DNA, 492 bp, Homo sapiens
  misc_feature: HIJSMM301DY8UQ.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaaccc

SEQ ID NO: 592991 - DNA, 507 bp, Homo sapiens
  misc_feature: HIJSMM301DE2UF.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgacccatctcggggctccaggctgaggacgaggctgcttattactgcagctcatatacaaggagcaccactctcgtggtatttggtggagggaccaagctgaccgtcctaggtcagccaaggctgccccctcggt

SEQ ID NO: 592992 - DNA, 473 bp, Homo sapiens
  misc_feature: HIJSMM301AW0VM.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctccttccgagtgccacttttggcggggggaccaaggtggacatcaaacgaa

SEQ ID NO: 592993 - DNA, 493 bp, Homo sapiens; identical to SEQ ID NO: 540127
  misc_feature: HIJSMM301DYA8D.10.17.B06.1.454.light.4.raw

SEQ ID NO: 592994 - DNA, 447 bp, Homo sapiens; identical to SEQ ID NO: 535201
  misc_feature: HIJSMM301AI00X.18.9.A09.1.454.light.4.raw

SEQ ID NO: 592995 - DNA, 518 bp, Homo sapiens
  misc_feature: HIJSMM301BJ9DO.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcaaactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcct

SEQ ID NO: 592996 - DNA, 497 bp, Homo sapiens
  misc_feature: HIJSMM301E23HT.40.57.F02.1.454.light.4.raw
  modified_base (469)..(469): a, c, t, g, unknown or other
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccganctgaccgtctacgtcagcccaaggctcg

SEQ ID NO: 592997 - DNA, 505 bp, Homo sapiens
  misc_feature: HIJSMM301DPKGZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtcaaacgaactagtggctgcaccatctgtcttctatcttccccg

SEQ ID NO: 592998 - DNA, 508 bp, Homo sapiens; identical to SEQ ID NO: 550253
  misc_feature: HIJSMM301EBRTR.9.55.E11.1.454.light.4.raw

SEQ ID NO: 592999 - DNA, 465 bp, Homo sapiens
  misc_feature: HIJSMM301BDSF5.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcccgtgggacccagagtggacatgaaacgaa

SEQ ID NO: 593000 - DNA, 490 bp, Homo sapiens
  misc_feature: HIJSMM301DCK5P.43.80.H03.1.454.light.4.raw
tgtgagtagtcacgaccggtgctcgatttagctgtgcgtcgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactacctctcactttcggaggagggaccagggtggagatcaaacgaactgtggctgcaccatctgtctt

SEQ ID NO: 593001 - DNA, 504 bp, Homo sapiens
  misc_feature: HIJSMM301COOWB.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggtagggaccaagggtggagatcaaacggaactgtggctgcaccatctgtctt

SEQ ID NO: 593002 - DNA, 519 bp, Homo sapiens
  misc_feature: HIJSMM301BZ4L7.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccacct

SEQ ID NO: 593003 - DNA, 504 bp, Homo sapiens
  misc_feature: HIJSMM301D7DYM.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggcctgccccctcggtcactcc

SEQ ID NO: 593004 - DNA, 507 bp, Homo sapiens
  misc_feature: HIJSMM301BEYX0.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcgttcggcggggggaccaagctgaccgtcctaggtcagcccaaggctgccccccg

SEQ ID NO: 593005 - DNA, 485 bp, Homo sapiens
  misc_feature: HIJSMM301CUW4Z.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttctcgccctcctcgctacgtaga

SEQ ID NO: 593006 - DNA, 473 bp, Homo sapiens
  misc_feature: HIJSMM301DCBRJ.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgtccat

SEQ ID NO: 593007 - DNA, 497 bp, Homo sapiens
  misc_feature: HIJSMM301EGFD5.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccgaaggtggagatcaaacgaactagtggctgcaccatctgtcttcat

SEQ ID NO: 593008 - DNA, 466 bp, Homo sapiens; identical to SEQ ID NO: 535366
  misc_feature: HIJSMM301B06AG.13.4.A04.1.454.light.4.raw

SEQ ID NO: 593009 - DNA, 517 bp, Homo sapiens
  misc_feature: HIJSMM301ATKZW.12.71.G05.1.454.light.4.raw
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggccaaagtgaccgtcctaagtcagcccaaggctgccccctcggtcactctgttcccaccct

SEQ ID NO: 593010 - DNA, 476 bp, Homo sapiens
  misc_feature: HIJSMM301BFLIW.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccc

SEQ ID NO: 593011 - DNA, 510 bp, Homo sapiens
  misc_feature: HIJSMM301D0OIK.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgccgagttttcggcggggggaccgaggctgaccgtcggcggtcagcccaaggcctgccccctcggtcactctcgttcccgccctcct

SEQ ID NO: 593012 - DNA, 511 bp, Homo sapiens
  misc_feature: HIJSMM301AESSA.49.16.B05.1.454.light.4.raw
agtcgagagacacgaccggtgctcgatttagagctcacgtaagggggctgtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtcctaggtcagcccaaggctgccccctcggtcactctgttcccaccctcct

SEQ ID NO: 593013 - DNA, 509 bp, Homo sapiens; identical to SEQ ID NO: 543772
  misc_feature: HIJSMM301E1BBU.2.21.B10.1.454.light.4.raw

SEQ ID NO: 593014 - DNA, 485 bp, Homo sapiens; identical to SEQ ID NO: 535985
  misc_feature: HIJSMM301BACKK.15.1.A01.1.454.light.4.raw

SEQ ID NO: 593015 - DNA, 486 bp, Homo sapiens; identical to SEQ ID NO: 535043
  misc_feature: HIJSMM301EG581.46.35.D02.1.454.light.4.raw

SEQ ID NO: 593016 - DNA, 493 bp, Homo sapiens
  misc_feature: HIJSMM301BA6T3.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagataccatcggggaaactgtgttgacacagtctccagccaccctgtctttgtctccgaggggaaagagcccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctgggacaggagttcactctcaccatcagcagcctgcagtctgaagtattttgctaatttattactgtcagcagtataataactggcctccgtacacttttggccgaggggaccaagctggagatacaaacgaactgtggctgcaccat

SEQ ID NO: 593017 - DNA, 511 bp, Homo sapiens
  misc_feature: HIJSMM301AI0BV.43.38.D05.1.454.light.4.raw
tgtgagtagtcacgaccggtgctcgatttagtatctgatagttgggtttggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccgagggtggaaagtacaaacgaaactagtggcgtgcaccaactctcgtcttctatcttccccg

SEQ ID NO: 593018 - DNA, 485 bp, Homo sapiens
  misc_feature: HIJSMM301BB2NN.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggtagggaccaaggtgcagatcaaacgaactgtggctgca

SEQ ID NO: 593019 - DNA, 488 bp, Homo sapiens
  misc_feature: HIJSMM301E3Y9K.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaactacacttcgtccgtcggtcgtacgagtagtcgactatataagaagaacgtaagtggtcgtg

SEQ ID NO: 593020 - DNA, 472 bp, Homo sapiens; identical to SEQ ID NO: 535898
  misc_feature: HIJSMM301CWJIF.15.8.A08.1.454.light.4.raw

SEQ ID NO: 593021 - DNA, 500 bp, Homo sapiens; identical to SEQ ID NO: 572186
  misc_feature: HIJSMM301B8MBG.5.86.H09.1.454.light.4.raw

SEQ ID NO: 593022 - DNA, 470 bp, Homo sapiens; identical to SEQ ID NO: 547523
  misc_feature: HIJSMM301CNZ0X.5.28.C06.1.454.light.4.raw

SEQ ID NO: 593023 - DNA, 422 bp, Homo sapiens; identical to SEQ ID NO: 447881
  misc_feature: HIJSMM301AE0M1.9.34.D01.1.454.light.4.raw

SEQ ID NO: 593024 - DNA, 504 bp, Homo sapiens
  misc_feature: HIJSMM301DCFRM.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatggggatgacaatctgagcggttgggtgttcggcggagggaccaaactgaccgtcctaggtcagcccaa

SEQ ID NO: 593025 - DNA, 504 bp, Homo sapiens; identical to SEQ ID NO: 545659
  misc_feature: HIJSMM301AO0TZ.7.71.G05.1.454.light.4.raw

SEQ ID NO: 593026 - DNA, 499 bp, Homo sapiens
  misc_feature: HIJSMM301BV835.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgaacaccagtacttcgcctggtaccagcagaaacctggccaggctcccaggctcctcatggatggtgcatccagcagggccactggcatcccagacaggttcgtggcagtgggtctgggacagacttcactctcaccatcagcagcctggagcctgaagattttgcaatttattactgtctaccagtatggtagttcacctctaactttcggcggagggtaccaaggtggagatcaaacgaactgtggctgcaccatctgtcttcatcttcccgt

SEQ ID NO: 593027 - DNA, 508 bp, Homo sapiens
  misc_feature: HIJSMM301CS15T.7.87.H10.1.454.light.4.raw
  modified_base (451)..(451): a, c, t, g, unknown or other
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaggacgaacggnggaagtcaacgaactagtggctgcaccactctgtcttctacttcttcccgtcccact

SEQ ID NO: 593028 - DNA, 377 bp, Homo sapiens; identical to SEQ ID NO: 536071
  misc_feature: HIJSMM301ENFOD.40.9.A09.1.454.light.4.raw

SEQ ID NO: 593029 - DNA, 485 bp, Homo sapiens
  misc_feature: HIJSMM301C9FAH.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccagggtcaccgtcctaggtcagcccaaggccaaccca

SEQ ID NO: 593030 - DNA, 471 bp, Homo sapiens
  misc_feature: HIJSMM301CJOEX.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacagggtcccaccaaggttcagcggaagtggatctgggacagattttaatttcaccatcagcagcctccaacgtgatgatgttgcaacatactattgtcagcaatatgattttgctcctccagtgccacttttgggcggggggaccaaggtggacatcaaacgaa

SEQ ID NO: 593031 - DNA, 495 bp, Homo sapiens; identical to SEQ ID NO: 564072
  misc_feature: HIJSMM301C5QZX.11.81.H04.1.454.light.4.raw

SEQ ID NO: 593032 - DNA, 495 bp, Homo sapiens; identical to SEQ ID NO: 538277
  misc_feature: HIJSMM301CRHVF.16.53.E09.1.454.light.4.raw

SEQ ID NO: 593033 - DNA, 474 bp, Homo sapiens
  misc_feature: HIJSMM301CNAH0.52.2.A02.1.454.light.4.raw
cgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaa

SEQ ID NO: 593034 - DNA, 503 bp, Homo sapiens
  misc_feature: HIJSMM301BPZUQ.48.83.H06.1.454.light.4.raw
agtatacatacacgaccggtgctcgatttagatcacgtgcgtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccaccctcct

SEQ ID NO: 593035 - DNA, 499 bp, Homo sapiens
  misc_feature: HIJSMM301BCN3I.40.42.D09.1.454.light.4.raw
tctagcgactcacgaccggtgctcgatttagacacatacgcaagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtctaggtcagcccaaggctgccccctcggtca

SEQ ID NO: 593036 - DNA, 504 bp, Homo sapiens; identical to SEQ ID NO: 535561
  misc_feature: HIJSMM301CIK89.4.57.F02.1.454.light.4.raw

SEQ ID NO: 593037 - DNA, 453 bp, Homo sapiens; identical to SEQ ID NO: 545340
  misc_feature: HIJSMM301EBMPA.19.86.H09.1.454.light.4.raw

SEQ ID NO: 593038 - DNA, 488 bp, Homo sapiens; identical to SEQ ID NO: 543022
  misc_feature: HIJSMM301EU70Y.9.59.F04.1.454.light.4.raw

SEQ ID NO: 593039 - DNA, 503 bp, Homo sapiens
  misc_feature: HIJSMM301CG8PO.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagccctccctgtccatcagtggactccggtctgaggatgaggctgactactattgttcaggatgggattacagcctacatgctcggctgttcggcggagggaccaaactgaccgtcttaggtcagcccaaggctgccccccg

SEQ ID NO: 593040 - DNA, 491 bp, Homo sapiens
  misc_feature: HIJSMM301B6VWF.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaactgaccgtcctaggtcagcccaaggct

SEQ ID NO: 593041 - DNA, 473 bp, Homo sapiens
  misc_feature: HIJSMM301BFQX0.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcctaagtcagcccc

SEQ ID NO: 593042 - DNA, 489 bp, Homo sapiens
  misc_feature: HIJSMM301B9H41.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccccactg

SEQ ID NO: 593043 - DNA, 490 bp, Homo sapiens; identical to SEQ ID NO: 543909
  misc_feature: HIJSMM301B7UUY.14.55.E11.1.454.light.4.raw

SEQ ID NO: 593044 - DNA, 492 bp, Homo sapiens; identical to SEQ ID NO: 534967
  misc_feature: HIJSMM301EDLGO.47.64.F09.1.454.light.4.raw

SEQ ID NO: 593045 - DNA, 502 bp, Homo sapiens
  misc_feature: HIJSMM301AMPCF.43.14.B03.1.454.light.4.raw
tgtgagtagtcacgaccggtgctcgatttagtgtgagtagttccgcggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcacttatgtcttcggaactgggaccaaggtcaccgacctaggtcagcccaaggccaacccactgtca

SEQ ID NO: 593046 - DNA, 476 bp, Homo sapiens
  misc_feature: HIJSMM301C0ZQI.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctgggactgaagtgcatatgaagagaactgtggctgcaa

SEQ ID NO: 593047 - DNA, 521 bp, Homo sapiens; identical to SEQ ID NO: 538715
  misc_feature: HIJSMM301ALOPE.27.23.C01.1.454.light.4.raw

SEQ ID NO: 593048 - DNA, 504 bp, Homo sapiens; identical to SEQ ID NO: 539032
  misc_feature: HIJSMM301A1V8W.19.67.G01.1.454.light.4.raw

SEQ ID NO: 593049 - DNA, 504 bp, Homo sapiens; identical to SEQ ID NO: 569212
  misc_feature: HIJSMM301BAQJR.40.67.G01.1.454.light.4.raw

SEQ ID NO: 593050 - DNA, 501 bp, Homo sapiens
  misc_feature: HIJSMM301BW1G0.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcgccaagggaccaaggtggaaatcaaacgaactgtggctgcaccatctgtcttcatcttccccg

SEQ ID NO: 593051 - DNA, 489 bp, Homo sapiens; identical to SEQ ID NO: 576308
  misc_feature: HIJSMM301C3SZN.13.46.E02.1.454.light.4.raw

SEQ ID NO: 593052 - DNA, 509 bp, Homo sapiens; identical to SEQ ID NO: 535457
  misc_feature: HIJSMM301BJ83B.17.33.C11.1.454.light.4.raw

SEQ ID NO: 593053 - DNA, 494 bp, Homo sapiens
  misc_feature: HIJSMM301BFAQ3.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgagattttgcagtgtattattgtcagcaatatggtaggtcacctgggacttttggccaggggaccaagctggagatcaaacgaactgtggctgcaccatctgtctt

SEQ ID NO: 593054 - DNA, 521 bp, Homo sapiens; identical to SEQ ID NO: 539470
  misc_feature: HIJSMM301D94R3.27.23.C01.1.454.light.4.raw

SEQ ID NO: 593055 - DNA, 497 bp, Homo sapiens; identical to SEQ ID NO: 536371
  misc_feature: HIJSMM301DE7UC.16.78.H01.1.454.light.4.raw

SEQ ID NO: 593056 - DNA, 484 bp, Homo sapiens
  misc_feature: HIJSMM301C4P5U.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccagggtcaccgtctaggtcagcccaaggccaaccca

SEQ ID NO: 593057 - DNA, 506 bp, Homo sapiens
  misc_feature: HIJSMM301BUN8T.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtc

SEQ ID NO: 593058 - DNA, 484 bp, Homo sapiens; identical to SEQ ID NO: 535400
  misc_feature: HIJSMM301A41DE.46.26.C04.1.454.light.4.raw

SEQ ID NO: 593059 - DNA, 506 bp, Homo sapiens
  misc_feature: HIJSMM301ALQEG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcctccgtcccctcctacctacttaccgttaccgttacgtaggacgggccgggtcggtcggacggaacggccgactaagtag

SEQ ID NO: 593060 - DNA, 497 bp, Homo sapiens; identical to SEQ ID NO: 539718
  misc_feature: HIJSMM301BTG3E.40.54.E10.1.454.light.4.raw

SEQ ID NO: 593061 - DNA, 520 bp, Homo sapiens; identical to SEQ ID NO: 550805
  misc_feature: HIJSMM301DN6X3.27.23.C01.1.454.light.4.raw
  modified_base (516)..(516): a, c, t, g, unknown or other

SEQ ID NO: 593062 - DNA, 507 bp, Homo sapiens
  misc_feature: HIJSMM301BU6JB.49.65.F10.1.454.light.4.raw
agtcgagagacacgaccggtgctcgatttagctacgctctaaggggctgggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccct

SEQ ID NO: 593063 - DNA, 506 bp, Homo sapiens; identical to SEQ ID NO: 573169
  misc_feature: HIJSMM301BP8IJ.11.67.G01.1.454.light.4.raw

SEQ ID NO: 593064 - DNA, 495 bp, Homo sapiens; identical to SEQ ID NO: 535007
  misc_feature: HIJSMM301AF8UN.22.5.A05.1.454.light.4.raw

SEQ ID NO: 593065 - DNA, 516 bp, Homo sapiens; identical to SEQ ID NO: 551464
  misc_feature: HIJSMM301A768T.17.33.C11.1.454.light.4.raw

SEQ ID NO: 593066 - DNA, 500 bp, Homo sapiens
  misc_feature: HIJSMM301BAKJ4.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgccagtcctatgacatgagctgagtggttcgtattgtcttcggatctgggaccaaggtcaccgtcctaagtcagcccaagg

SEQ ID NO: 593067 - DNA, 496 bp, Homo sapiens; identical to SEQ ID NO: 559952
  misc_feature: HIJSMM301C7VJH.16.78.H01.1.454.light.4.raw

SEQ ID NO: 593068 - DNA, 490 bp, Homo sapiens; identical to SEQ ID NO: 535234
  misc_feature: HIJSMM301BWECW.17.21.B10.1.454.light.4.raw

SEQ ID NO: 593069 - DNA, 518 bp, Homo sapiens
  misc_feature: HIJSMM301BZORL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgcccctcggtcactctgttcccgcct

SEQ ID NO: 593070 - DNA, 504 bp, Homo sapiens
  misc_feature: HIJSMM301ANG5A.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccactgtcactctgttcccgccct

SEQ ID NO: 593071 - DNA, 504 bp, Homo sapiens
  misc_feature: HIJSMM301AU5VI.2.71.G05.1.454.light.4.raw
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactgggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 593072 - DNA, 498 bp, Homo sapiens
  misc_feature: HIJSMM301A25F0.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatggttggggtttattactgcatgcaaggtttataccttcctcggactttcggtcccgtcgggtaccgacgagtaggagtgtcaaacgaaacgtgt

SEQ ID NO: 593073 - DNA, 481 bp, Homo sapiens
  misc_feature: HIJSMM301A9XUV.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcacatctgtctt

SEQ ID NO: 593074 - DNA, 505 bp, Homo sapiens; identical to SEQ ID NO: 555429
  misc_feature: HIJSMM301EIPYA.4.71.G05.1.454.light.4.raw

SEQ ID NO: 593075 - DNA, 454 bp, Homo sapiens
  misc_feature: HIJSMM301B29FO.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggtcatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 593076 - DNA, 504 bp, Homo sapiens; identical to SEQ ID NO: 573734
  misc_feature: HIJSMM301AYX93.7.31.C09.1.454.light.4.raw

SEQ ID NO: 593077 - DNA, 514 bp, Homo sapiens; identical to SEQ ID NO: 542484
  misc_feature: HIJSMM301DNK99.48.53.E09.1.454.light.4.raw

SEQ ID NO: 593078 - DNA, 502 bp, Homo sapiens
  misc_feature: HIJSMM301AOKX0.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggaccaagctgaccgtcctaggtcagccaaggctcgccccctcggtcactctcgttccccg

SEQ ID NO: 593079 - DNA, 493 bp, Homo sapiens; identical to SEQ ID NO: 544666
  misc_feature: HIJSMM301BEAQB.12.23.C01.1.454.light.4.raw

SEQ ID NO: 593080 - DNA, 495 bp, Homo sapiens
  misc_feature: HIJSMM301A2C1I.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtttcggccaagggaccaaggtggagtatcagacgaactgttgg

SEQ ID NO: 593081 - DNA, 494 bp, Homo sapiens; identical to SEQ ID NO: 592127
  misc_feature: HIJSMM301DQFPZ.40.11.A11.1.454.light.4.raw

SEQ ID NO: 593082 - DNA, 500 bp, Homo sapiens
  misc_feature: HIJSMM301DUB9A.48.3.A03.1.454.light.4.raw
agtatacatacacgaccggtgctcgatttagagagcgtcacagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 593083 - DNA, 478 bp, Homo sapiens
  misc_feature: HIJSMM301BEO5C.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggaccaggctatggatgaggctgactattactgtcaggcgtggacatcagcagtgaggtggttttcggcggagggaccgaagctgaccgtcctaagtcagacccg

SEQ ID NO: 593084 - DNA, 487 bp, Homo sapiens; identical to SEQ ID NO: 547557
  misc_feature: HIJSMM301BA0R5.7.75.G09.1.454.light.4.raw

SEQ ID NO: 593085 - DNA, 503 bp, Homo sapiens; identical to SEQ ID NO: 568855
  misc_feature: HIJSMM301A3HTX.9.71.G05.1.454.light.4.raw

SEQ ID NO: 593086 - DNA, 502 bp, Homo sapiens; identical to SEQ ID NO: 539609
  misc_feature: HIJSMM301CX78F.7.71.G05.1.454.light.4.raw

SEQ ID NO: 593087 - DNA, 540 bp, Homo sapiens
  misc_feature: HIJSMM301EIMHM.10.87.H10.1.454.light.4.raw
  modified_base (516)..(516): a, c, t, g, unknown or other
  modified_base (526)..(526): a, c, t, g, unknown or other
catagtagtgcacgaccggtgctcgatttagcagtactgcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttancccccgtttnactcttcccgccat

SEQ ID NO: 593088 - DNA, 503 bp, Homo sapiens; identical to SEQ ID NO: 535140
  misc_feature: HIJSMM301A6AQM.18.37.D04.1.454.light.4.raw

SEQ ID NO: 593089 - DNA, 489 bp, Homo sapiens; identical to SEQ ID NO: 536013
  misc_feature: HIJSMM301AG8C6.26.23.C01.1.454.light.4.raw

SEQ ID NO: 593090 - DNA, 506 bp, Homo sapiens
  misc_feature: HIJSMM301A5O75.19.85.H08.1.454.light.4.raw
tactctcgtgcacgaccggtgctcgatttagtatcactcagtcgcggggtccaaacagagcttcagcaagcatagtgggaatctgcaccatgtcctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggtcta

SEQ ID NO: 593091 - DNA, 500 bp, Homo sapiens; identical to SEQ ID NO: 539795
  misc_feature: HIJSMM301CB15W.22.38.D05.1.454.light.4.raw

SEQ ID NO: 593092 - DNA, 389 bp, Homo sapiens; identical to SEQ ID NO: 540091
  misc_feature: HIJSMM301DKFFL.21.40.D07.1.454.light.4.raw

SEQ ID NO: 593093 - DNA, 495 bp, Homo sapiens
  misc_feature: HIJSMM301EDZR8.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatacaaacgaactgtggctgcaccatctgtcttcatt

SEQ ID NO: 593094 - DNA, 496 bp, Homo sapiens; identical to SEQ ID NO: 545011
  misc_feature: HIJSMM301CB30P.22.86.H09.1.454.light.4.raw

SEQ ID NO: 593095 - DNA, 472 bp, Homo sapiens; identical to SEQ ID NO: 565737
  misc_feature: HIJSMM301CCXPT.51.34.D01.1.454.light.4.raw

SEQ ID NO: 593096 - DNA, 489 bp, Homo sapiens; identical to SEQ ID NO: 535139
  misc_feature: HIJSMM301A4DCW.14.55.E11.1.454.light.4.raw

SEQ ID NO: 593097 - DNA, 478 bp, Homo sapiens; identical to SEQ ID NO: 582049
  misc_feature: HIJSMM301B74IA.21.25.C03.1.454.light.4.raw

SEQ ID NO: 593098 - DNA, 482 bp, Homo sapiens
  misc_feature: HIJSMM301ET4PW.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgtacttatttctgtctacaagattctaattaccctcggacgttcggtccgagggaccgaaagtcggaatgtcaaccgaactgtggctgcaccta

SEQ ID NO: 593099 - DNA, 507 bp, Homo sapiens
  misc_feature: HIJSMM301EXK7U.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggcccaaccccactgt

SEQ ID NO: 593100 - DNA, 494 bp, Homo sapiens
  misc_feature: HIJSMM301B6ZBQ.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtctaggtcagcccaaggctgccccctggtcactctgttcccaccctcct

SEQ ID NO: 593101 - DNA, 477 bp, Homo sapiens; identical to SEQ ID NO: 535266
  misc_feature: HIJSMM301AQX0Z.4.34.D01.1.454.light.4.raw

SEQ ID NO: 593102 - DNA, 508 bp, Homo sapiens
  misc_feature: HIJSMM301EMBXZ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatggggatggaccaatctgaggcggttgggtgttacggcggagggaccaaactgaccgtcctaggtcagcccaa

SEQ ID NO: 593103 - DNA, 511 bp, Homo sapiens
  misc_feature: HIJSMM301AU8RC.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgtcccta

SEQ ID NO: 593104 - DNA, 499 bp, Homo sapiens
  misc_feature: HIJSMM301DN9E9.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtctt

SEQ ID NO: 593105 - DNA, 503 bp, Homo sapiens
  misc_feature: HIJSMM301COE61.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggaccaaggtcaccgtcctaggacacgtgagactcaggaaatgaccagaggggagtgaatgagggtgcagagaactccatggctaccaggtcagccccaaggccaaccccactgtcactctgttcccgccctcctcta

SEQ ID NO: 593106 - DNA, 485 bp, Homo sapiens; identical to SEQ ID NO: 553349
  misc_feature: HIJSMM301DVCUV.47.38.D05.1.454.light.4.raw

SEQ ID NO: 593107 - DNA, 450 bp, Homo sapiens
  misc_feature: HIJSMM301ETM08.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttccccaccctcctccatacctcgta

SEQ ID NO: 593108 - DNA, 484 bp, Homo sapiens; identical to SEQ ID NO: 535400
  misc_feature: HIJSMM301BJ9N4.46.26.C04.1.454.light.4.raw

SEQ ID NO: 593109 - DNA, 479 bp, Homo sapiens
  misc_feature: HIJSMM301DMWZ0.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaagttgaacatcaatcgaactgt

SEQ ID NO: 593110 - DNA, 484 bp, Homo sapiens; identical to SEQ ID NO: 535441
  misc_feature: HIJSMM301BJ740.26.60.F05.1.454.light.4.raw

SEQ ID NO: 593111 - DNA, 482 bp, Homo sapiens; identical to SEQ ID NO: 535920
  misc_feature: HIJSMM301BOUCF.19.71.G05.1.454.light.4.raw

SEQ ID NO: 593112 - DNA, 494 bp, Homo sapiens; identical to SEQ ID NO: 534994
  misc_feature: HIJSMM301CPB0T.27.78.H01.1.454.light.4.raw

SEQ ID NO: 593113 - DNA, 481 bp, Homo sapiens; identical to SEQ ID NO: 535993
  misc_feature: HIJSMM301BX68L.21.25.C03.1.454.light.4.raw

SEQ ID NO: 593114 - DNA, 486 bp, Homo sapiens; identical to SEQ ID NO: 535523
  misc_feature: HIJSMM301DQS1W.22.73.G07.1.454.light.4.raw

SEQ ID NO: 593115 - DNA, 492 bp, Homo sapiens; identical to SEQ ID NO: 570842
  misc_feature: HIJSMM301BOZLS.22.65.F10.1.454.light.4.raw

SEQ ID NO: 593116 - DNA, 451 bp, Homo sapiens
  misc_feature: HIJSMM301AHB0C.48.78.H01.1.454.light.4.raw
agtatacatacacgaccggtgctcgatttagtgtgagtagtttgggtttggggggacgtcgtgatgacccagtctccagactccctggcagtgtctctgggcgggaggggccaccgatacgaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccatctgtctttatcttcccgccatctgatatgtatact

SEQ ID NO: 593117 - DNA, 503 bp, Homo sapiens
  misc_feature: HIJSMM301CADSY.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactccttgtggttttcggcggagggaccaagctgaccgtcctaggtcagcccaaggctgcccctcggtcactctcgttcccgccctcctcgctacgtaga

SEQ ID NO: 593118 - DNA, 486 bp, Homo sapiens; identical to SEQ ID NO: 535043
  misc_feature: HIJSMM301CDBOC.46.35.D02.1.454.light.4.raw

SEQ ID NO: 593119 - DNA, 504 bp, Homo sapiens
  misc_feature: HIJSMM301B96YK.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggcctcccagataccaccggagaaattgtgttgacacagtctccagccaccctgtctttgtctccgaggggaaagagccaccctctcctgcagggccagtcagagtattagcaactacttagcctggtaccaacagaaacctggccaggcctcccaggctcctcatctatgatgcgtccaacagggccactggcatcccagccaggttcagtggcggtgggtctgggacagacttcactctcaccatcagcagcctagagcctgaagtattttgcagtttattactgtcagcagcgtagcaactggcctccgatcaccttcggccaagggacacgactggagattaaacgaactgtggctgcaccatctgtcttcatt

SEQ ID NO: 593120 - DNA, 505 bp, Homo sapiens; identical to SEQ ID NO: 539292
  misc_feature: HIJSMM301D2C2X.19.85.H08.1.454.light.4.raw

SEQ ID NO: 593121 - DNA, 480 bp, Homo sapiens
  misc_feature: HIJSMM301ARZVW.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctagtgtcttcggaactgggaccaagggtcaccgtcctaaggtcagacccccg

SEQ ID NO: 593122 - DNA, 493 bp, Homo sapiens
  misc_feature: HIJSMM301D2XPD.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctcctgaccatctctgggctccaggctgaggacgagggtgattattactgcagctcatatagaagtggcagcactctcgtattcggcggtgggaccaagctgaccgtcctaggtcagcccaagg

SEQ ID NO: 593123 - DNA, 493 bp, Homo sapiens; identical to SEQ ID NO: 535047
  misc_feature: HIJSMM301ESBNM.16.53.E09.1.454.light.4.raw

SEQ ID NO: 593124 - DNA, 497 bp, Homo sapiens; identical to SEQ ID NO: 535740
  misc_feature: HIJSMM301ELOGT.3.71.G05.1.454.light.4.raw

SEQ ID NO: 593125 - DNA, 511 bp, Homo sapiens
  misc_feature: HIJSMM301BN7B3.10.71.G05.1.454.light.4.raw
catagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggcatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaataagaggtcaaacgaacgtagtggctgcgaccattc

SEQ ID NO: 593126 - DNA, 493 bp, Homo sapiens; identical to SEQ ID NO: 543949
  misc_feature: HIJSMM301CQZ2E.16.68.G02.1.454.light.4.raw

SEQ ID NO: 593127 - DNA, 485 bp, Homo sapiens
  misc_feature: HIJSMM301DSY0T.48.68.G02.1.454.light.4.raw
agtatacatacacgaccggtgctcgatttagtcgatagtgaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcagaccccg

SEQ ID NO: 593128 - DNA, 514 bp, Homo sapiens; identical to SEQ ID NO: 547648
  misc_feature: HIJSMM301DWI94.16.1.A01.1.454.light.4.raw

SEQ ID NO: 593129 - DNA, 491 bp, Homo sapiens
  misc_feature: HIJSMM301DT3R7.11.12.B01.1.454.light.4.raw
  modified_base (456)..(456): a, c, t, g, unknown or other
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtnttaggtcagcccaaggctgccccctcggtcactcc

SEQ ID NO: 593130 - DNA, 513 bp, Homo sapiens
  misc_feature: HIJSMM301C88AG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcgacggacgaacggtaggaagtacaacgaactacgtggcgtgcgaccactctgtcttctactcttcccgcccactc

SEQ ID NO: 593131 - DNA, 506 bp, Homo sapiens; identical to SEQ ID NO: 563474
  misc_feature: HIJSMM301ANOGN.10.27.C05.1.454.light.4.raw

SEQ ID NO: 593132 - DNA, 512 bp, Homo sapiens
  misc_feature: HIJSMM301CD8YM.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttggtgttcggcggagggaccaagttgacgtcctaggtcagcccaaggctgccccctcggtcactctgttccccg

SEQ ID NO: 593133 - DNA, 509 bp, Homo sapiens; identical to SEQ ID NO: 536348
  misc_feature: HIJSMM301EO7JD.43.67.G01.1.454.light.4.raw

SEQ ID NO: 593134 - DNA, 488 bp, Homo sapiens
  misc_feature: HIJSMM301DBH0F.4.34.D01.1.454.light.4.raw
agcactgtagcacgaccggtgctcgatttagatcgtctgtgttgggtttgggggaggaacgtgctcagttaggacccagacggaaccatggaagccccagcgcagcttctcttcctcctgctacgtctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggtccaggctcccaggctcctcatctatggtgcatccaccagggccactggtatcccagccaggttcaagtggccagtgggtctgggacagagttcactctcaccatcagcagcctgcagtctgaagattttgcggtttattactgtcagcagtatgataactggctgtacacttttggccaggggaccaagctggagatcgaggcgaactgtggctgca

SEQ ID NO: 593135 - DNA, 506 bp, Homo sapiens
  misc_feature: HIJSMM301BEOKX.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagccctccctgaccatcagtgggctccggtccgaggatgaggctgattattactgtgcaccgtgggatgacatcctgaatggtccggtgttcgggcggagggaccaggctgaccgtcctaagtcagcccaaggctcg

SEQ ID NO: 593136 - DNA, 454 bp, Homo sapiens; identical to SEQ ID NO: 534964
  misc_feature: HIJSMM301BTZ2D.19.86.H09.1.454.light.4.raw

SEQ ID NO: 593137 - DNA, 502 bp, Homo sapiens
  misc_feature: HIJSMM301DQ89I.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattattacttcgtggacgttcggccgaagggaccaaaggtggataatcagacgaaacctggtgg

SEQ ID NO: 593138 - DNA, 476 bp, Homo sapiens
  misc_feature: HIJSMM301B2WG2.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcgtcctcggacgtgaagtgcatatgaagagaactagtggctgca

SEQ ID NO: 593139 - DNA, 445 bp, Homo sapiens; identical to SEQ ID NO: 551846
  misc_feature: HIJSMM301B324N.14.76.G10.1.454.light.4.raw

SEQ ID NO: 593140 - DNA, 502 bp, Homo sapiens
  misc_feature: HIJSMM301C09XV.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgcccctcggtcactctgttcccaccctcctcgacgtgcgtct

SEQ ID NO: 593141 - DNA, 485 bp, Homo sapiens; identical to SEQ ID NO: 536040
  misc_feature: HIJSMM301CJ0F9.15.1.A01.1.454.light.4.raw

SEQ ID NO: 593142 - DNA, 493 bp, Homo sapiens
  misc_feature: HIJSMM301DXSKI.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcgacgggggcccaggcagatgatgaatctcattattactgtgcactgcatttgcgtgatgtcaattatgttgttcggcggagggaacc

SEQ ID NO: 593143 - DNA, 493 bp, Homo sapiens; identical to SEQ ID NO: 544335
  misc_feature: HIJSMM301C743P.5.57.F02.1.454.light.4.raw

SEQ ID NO: 593144 - DNA, 481 bp, Homo sapiens; identical to SEQ ID NO: 535993
  misc_feature: HIJSMM301A5Q6C.21.25.C03.1.454.light.4.raw

SEQ ID NO: 593145 - DNA, 503 bp, Homo sapiens; identical to SEQ ID NO: 538884
  misc_feature: HIJSMM301DIG6H.27.78.H01.1.454.light.4.raw

SEQ ID NO: 593146 - DNA, 482 bp, Homo sapiens
  misc_feature: HIJSMM301CKMEH.41.33.C11.1.454.light.4.raw
tctatactatcacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacc

SEQ ID NO: 593147 - DNA, 510 bp, Homo sapiens
  misc_feature: HIJSMM301EVAT2.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttatactgtcaacaatattattctactccgccgacgttcggccgggggaccgaacgtggaatacaaacgaactagtggctgcaccactctgtcttcta

SEQ ID NO: 593148 - DNA, 489 bp, Homo sapiens; identical to SEQ ID NO: 536013
  misc_feature: HIJSMM301AIXBZ.26.23.C01.1.454.light.4.raw

SEQ ID NO: 593149 - DNA, 513 bp, Homo sapiens; identical to SEQ ID NO: 565866
  misc_feature: HIJSMM301AGW8C.15.86.H09.1.454.light.4.raw

SEQ ID NO: 593150 - DNA, 472 bp, Homo sapiens
  misc_feature: HIJSMM301CY8E4.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaagcccctaagctcctgatctatgctgcttccagtttgcaaagtgggtcccatcaaggttcagtggcagtggatctgggacagatttcactctcactgtcagcagtctgcaatttgaagattttgctaacttactactgtcaacagagtttcagtatcccttggactttggtcaagggaccaaggtggaaatacaaacgaa

SEQ ID NO: 593151 - DNA, 526 bp, Homo sapiens
  misc_feature: HIJSMM301BNOZD.16.59.F04.1.454.light.4.raw
tgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggaccccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgagtagtaca

SEQ ID NO: 593152 - DNA, 433 bp, Homo sapiens; identical to SEQ ID NO: 535093
  misc_feature: HIJSMM301A8EQO.18.5.A05.1.454.light.4.raw

SEQ ID NO: 593153 - DNA, 505 bp, Homo sapiens; identical to SEQ ID NO: 551816
  misc_feature: HIJSMM301CCLDS.18.78.H01.1.454.light.4.raw

SEQ ID NO: 593154 - DNA, 500 bp, Homo sapiens; identical to SEQ ID NO: 542309
  misc_feature: HIJSMM301DWUW9.12.86.H09.1.454.light.4.raw

SEQ ID NO: 593155 - DNA, 500 bp, Homo sapiens
  misc_feature: HIJSMM301ATNVE.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgtaccatctgtcttcatcttccccg

SEQ ID NO: 593156 - DNA, 507 bp, Homo sapiens; identical to SEQ ID NO: 563344
  misc_feature: HIJSMM301B2NE0.3.79.H02.1.454.light.4.raw

SEQ ID NO: 593157 - DNA, 479 bp, Homo sapiens
  misc_feature: HIJSMM301BFNES.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtgggtcccatcaaggttcagcggcagtgcatctgggacagaattcactctcaccatcagcagcctgcagcctgatgattttgcaacttattactgccaacagtattatacttatccatggacgttcggccaagggaccgaaggtggaaatacaaacgaactagtggctgcaccat

SEQ ID NO: 593158 - DNA, 513 bp, Homo sapiens
  misc_feature: HIJSMM301CHWFS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaacggaccgaacggtaggaagtacaaacgaactagtggcgtgcaccatctgtcttctatcttcccgcccact

SEQ ID NO: 593159 - DNA, 486 bp, Homo sapiens
  misc_feature: HIJSMM301A4ESW.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccacggtggagatcaaacgaactgtggctgcaccatctgtt

SEQ ID NO: 593160 - DNA, 469 bp, Homo sapiens
  misc_feature: HIJSMM301CO6XF.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcactgaggtggtattcggcggagggaccaagctgaccgtccttc

SEQ ID NO: 593161 - DNA, 503 bp, Homo sapiens
  misc_feature: HIJSMM301D2SZ2.9.53.E09.1.454.light.4.raw
  modified_base (437)..(437): a, c, t, g, unknown or other
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtnacactcccgtggtattcggcggagggaccaaggtgaccgtcctaggtcagcccaaggctgcccccc

SEQ ID NO: 593162 - DNA, 488 bp, Homo sapiens; identical to SEQ ID NO: 537673
  misc_feature: HIJSMM301D5IJ1.12.31.C09.1.454.light.4.raw

SEQ ID NO: 593163 - DNA, 502 bp, Homo sapiens
  misc_feature: HIJSMM301CXO10.48.67.G01.1.454.light.4.raw
agtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttccccg

SEQ ID NO: 593164 - DNA, 492 bp, Homo sapiens
  misc_feature: HIJSMM301CIL0H.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgcagtttattactgtcagcagtatgatacctggcctccgtacacttttggccggggaccaagctggaaatcaagcgaactgtggctgcacccatctgtcttcatt

SEQ ID NO: 593165 - DNA, 503 bp, Homo sapiens
  misc_feature: HIJSMM301ANRNF.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataacttttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgctacgtaga

SEQ ID NO: 593166 - DNA, 502 bp, Homo sapiens; identical to SEQ ID NO: 537363
  misc_feature: HIJSMM301BCA3E.18.23.C01.1.454.light.4.raw

SEQ ID NO: 593167 - DNA, 516 bp, Homo sapiens
  misc_feature: HIJSMM301CG78S.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcacgtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttcccta

SEQ ID NO: 593168 - DNA, 510 bp, Homo sapiens
  misc_feature: HIJSMM301D44O1.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccg

SEQ ID NO: 593169 - DNA, 500 bp, Homo sapiens; identical to SEQ ID NO: 584730
  misc_feature: HIJSMM301CC1ZP.52.38.D05.1.454.light.4.raw

SEQ ID NO: 593170 - DNA, 487 bp, Homo sapiens; identical to SEQ ID NO: 537009
  misc_feature: HIJSMM301BYC3N.12.88.H11.1.454.light.4.raw

SEQ ID NO: 593171 - DNA, 487 bp, Homo sapiens; identical to SEQ ID NO: 588595
  misc_feature: HIJSMM301DTRNK.43.76.G10.1.454.light.4.raw

SEQ ID NO: 593172 - DNA, 444 bp, Homo sapiens
  misc_feature: HIJSMM301DPRZK.47.85.H08.1.454.light.4.raw
agctcacgtacacgaccggtgctcgatttagtatcactcagtcgcggggtcctgggcccagtctgccccgactcagcctacctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgcccctcggtcactctgttcccaccctcctctacgtgagct

SEQ ID NO: 593173 - DNA, 441 bp, Homo sapiens; identical to SEQ ID NO: 535074
  misc_feature: HIJSMM301A54V3.11.3.A03.1.454.light.4.raw

SEQ ID NO: 593174 - DNA, 485 bp, Homo sapiens; identical to SEQ ID NO: 535985
  misc_feature: HIJSMM301E1EFQ.15.1.A01.1.454.light.4.raw

SEQ ID NO: 593175 - DNA, 488 bp, Homo sapiens; identical to SEQ ID NO: 536554
  misc_feature: HIJSMM301D6NFB.26.37.D04.1.454.light.4.raw

SEQ ID NO: 593176 - DNA, 486 bp, Homo sapiens
  misc_feature: HIJSMM301CZ1KV.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtcaacaatattattatacttcgtgacgttcggccaagggaccaaggtggatatcagacgaa

SEQ ID NO: 593177 - DNA, 445 bp, Homo sapiens
  misc_feature: HIJSMM301AORL3.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtccactctgttcccaccctcctcgacacgcgag

SEQ ID NO: 593178 - DNA, 496 bp, Homo sapiens; identical to SEQ ID NO: 567169
  misc_feature: HIJSMM301DKJAR.41.18.B07.1.454.light.4.raw

SEQ ID NO: 593179 - DNA, 496 bp, Homo sapiens
  misc_feature: HIJSMM301BW97M.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctcttttcggcggggggaccaagctggagatcaaccgaactgtggctgcaccatctgtt

SEQ ID NO: 593180 - DNA, 498 bp, Homo sapiens; identical to SEQ ID NO: 544837
  misc_feature: HIJSMM301AXSK6.11.71.G05.1.454.light.4.raw

SEQ ID NO: 593181 - DNA, 476 bp, Homo sapiens
  misc_feature: HIJSMM301DZAPD.12.49.E05.1.454.light.4.raw
  modified_base (439)..(439): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgccccccttnacccttcggccaagggacacgactggagattagaacg

SEQ ID NO: 593182 - DNA, 484 bp, Homo sapiens; identical to SEQ ID NO: 535400
  misc_feature: HIJSMM301CEGUW.46.26.C04.1.454.light.4.raw

SEQ ID NO: 593183 - DNA, 512 bp, Homo sapiens
  misc_feature: HIJSMM301EMHOV.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgttcccacctcct

SEQ ID NO: 593184 - DNA, 483 bp, Homo sapiens
  misc_feature: HIJSMM301CSKOJ.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcat

SEQ ID NO: 593185 - DNA, 496 bp, Homo sapiens
  misc_feature: HIJSMM301BM0DT.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactagtggctgca

SEQ ID NO: 593186 - DNA, 476 bp, Homo sapiens; identical to SEQ ID NO: 538611
  misc_feature: HIJSMM301CTM9U.7.81.H04.1.454.light.4.raw

SEQ ID NO: 593187 - DNA, 485 bp, Homo sapiens; identical to SEQ ID NO: 570096
  misc_feature: HIJSMM301CYSTM.46.35.D02.1.454.light.4.raw

SEQ ID NO: 593188 - DNA, 518 bp, Homo sapiens
  misc_feature: HIJSMM301DP7BB.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactgtcactctccg

SEQ ID NO: 593189 - DNA, 485 bp, Homo sapiens; identical to SEQ ID NO: 536040
  misc_feature: HIJSMM301DSGA2.15.1.A01.1.454.light.4.raw

SEQ ID NO: 593190 - DNA, 490 bp, Homo sapiens
  misc_feature: HIJSMM301A1YAF.51.33.C11.1.454.light.4.raw
cgatcgtatacacgaccggtgctcgatttagagtgagctcgttgggtttggggagagctgctcagttaggacccagagggaaccatggaaaccccagcgcagcttctcttcctcctgctactctggctcccagatacctccggtgagattgtgttgacgcagtctccaggcaccctgtctttgtttccaggggacagagccaccctctcctgcagggccagtcagagttttagcagcaactacttggcctggtaccagcagaaacctggccaggctcccaggctcctcatctatggtgcatccagcagggccgctggcatcccagacaggttcagtggcagtgggtctgggacagacttcagtctcaccatcagcggactggagcctgaagattttgcagtgtattactgtcagcaccatggtagctcatcccggtacacttttggccggggaccaagctggagatcaaaacgaactgtggctgcaccat

SEQ ID NO: 593191 - DNA, 509 bp, Homo sapiens; identical to SEQ ID NO: 553073
  misc_feature: HIJSMM301ARN8I.16.1.A01.1.454.light.4.raw

SEQ ID NO: 593192 - DNA, 494 bp, Homo sapiens; identical to SEQ ID NO: 578418
  misc_feature: HIJSMM301AIR9B.10.79.H02.1.454.light.4.raw

SEQ ID NO: 593193 - DNA, 504 bp, Homo sapiens
  misc_feature: HIJSMM301COD0I.40.67.G01.1.454.light.4.raw
tctagcgactcacgaccggtgctcgatttagagtatacatattgggtttgggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatccttcccgcc

SEQ ID NO: 593194 - DNA, 490 bp, Homo sapiens; identical to SEQ ID NO: 535234
  misc_feature: HIJSMM301BNZCC.17.21.B10.1.454.light.4.raw

SEQ ID NO: 593195 - DNA, 497 bp, Homo sapiens; identical to SEQ ID NO: 539718
  misc_feature: HIJSMM301D7GQK.40.54.E10.1.454.light.4.raw

SEQ ID NO: 593196 - DNA, 514 bp, Homo sapiens
  misc_feature: HIJSMM301AZ99Z.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaatggtgtcccatcaaggttcagtggcagtggatctgggacacaattcactctcaccatcgctgatctgcagcctgaagattttgcaacttactactgtcaacagagtttcagtgtccccccggacgtcggtccacgggaccgacacgtagaatagagacggaactagtaggcgtgcgaccatctgtcttctatcttcccgtccccg

SEQ ID NO: 593197 - DNA, 486 bp, Homo sapiens; identical to SEQ ID NO: 535043
  misc_feature: HIJSMM301DKVOY.46.35.D02.1.454.light.4.raw

SEQ ID NO: 593198 - DNA, 523 bp, Homo sapiens
  misc_feature: HIJSMM301EG7BI.41.19.B08.1.454.light.4.raw
  modified_base (507)..(507): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaaccagccacaccttgctcttcggaactgggaccaacggcaatcgtcctaggtcagcccaaggccaacccaacctgtcacnctgttcccaccctcct

SEQ ID NO: 593199 - DNA, 514 bp, Homo sapiens
  misc_feature: HIJSMM301CPP8C.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccgaaggctgaccggtcctggagtcagcccaaaggctgccccctccggtcactctgttcccaccctcctctaaccg

SEQ ID NO: 593200 - DNA, 480 bp, Homo sapiens; identical to SEQ ID NO: 556114
  misc_feature: HIJSMM301AQKMM.21.25.C03.1.454.light.4.raw

SEQ ID NO: 593201 - DNA, 494 bp, Homo sapiens
  misc_feature: HIJSMM301EGS94.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctgactcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 593202 - DNA, 503 bp, Homo sapiens; identical to SEQ ID NO: 537189
  misc_feature: HIJSMM301AVK56.19.85.H08.1.454.light.4.raw

SEQ ID NO: 593203 - DNA, 495 bp, Homo sapiens
  misc_feature: HIJSMM301DG581.41.16.B05.1.454.light.4.raw
tctatactatcacgaccggtgctcgatttagagctcacgtaaggggggaggaactgctcagttaggacccagacggaaccatggaagccccacgcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagatttgcagtttattactgtcaccaatataataactggtactacttttggccaggggaccaagctcgagatcaaacgaactgtggctgcaccatctgtcttcatcttcccg

SEQ ID NO: 593204 - DNA, 494 bp, Homo sapiens; identical to SEQ ID NO: 534994
  misc_feature: HIJSMM301AOKWE.27.78.H01.1.454.light.4.raw

SEQ ID NO: 593205 - DNA, 511 bp, Homo sapiens
  misc_feature: HIJSMM301DVOKL.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctggtcactctgttcccgccctcctca

SEQ ID NO: 593206 - DNA, 515 bp, Homo sapiens
  misc_feature: HIJSMM301B9QO2.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaatttggtcatatgttgttcggcggagggaccaagctgaccgtcctcggtcagcccaaggctgccccctcggtcactctgttcccgccctcct

SEQ ID NO: 593207 - DNA, 441 bp, Homo sapiens; identical to SEQ ID NO: 550529
  misc_feature: HIJSMM301CU3E4.41.9.A09.1.454.light.4.raw

SEQ ID NO: 593208 - DNA, 520 bp, Homo sapiens
  misc_feature: HIJSMM301AZNI0.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctcggtgtgcagcctgaggacgaggctgactattactgcctactctactttggtggtgctgtgctattcggcggagggaccaaggctgaccgtcttaagtcagcccaaggctgccccctcggtccactctgtttcccaccctccttcc

SEQ ID NO: 593209 - DNA, 508 bp, Homo sapiens
  misc_feature: HIJSMM301EN16X.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaaggtggaaatcaaaccgaactagtggctgcaccactctgtcttctactcttcccgccta

SEQ ID NO: 593210 - DNA, 383 bp, Homo sapiens; identical to SEQ ID NO: 447524
  misc_feature: HIJSMM301B8DRP.41.26.C04.1.454.light.4.raw

SEQ ID NO: 593211 - DNA, 507 bp, Homo sapiens
  misc_feature: HIJSMM301ELSAB.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggtttttcggcggagggaccaggctgaccgtcctaagtcagcccaaggctgccccctcggt

SEQ ID NO: 593212 - DNA, 506 bp, Homo sapiens
  misc_feature: HIJSMM301EXGT7.5.59.F04.1.454.light.4.raw
atcagacacgcacgaccggtgctcgatttagtacacacacttagggattggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccaaggtggaaagtacaaacgaactagtggctgcaccatctgtcttcatcttccccg

SEQ ID NO: 593213 - DNA, 489 bp, Homo sapiens; identical to SEQ ID NO: 543840
  misc_feature: HIJSMM301BOOBH.12.88.H11.1.454.light.4.raw

SEQ ID NO: 593214 - DNA, 479 bp, Homo sapiens
  misc_feature: HIJSMM301CICK8.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaacggtggaaatcaaacgaactagtggctgca

SEQ ID NO: 593215 - DNA, 504 bp, Homo sapiens; identical to SEQ ID NO: 561260
  misc_feature: HIJSMM301DFRA7.18.78.H01.1.454.light.4.raw

SEQ ID NO: 593216 - DNA, 486 bp, Homo sapiens; identical to SEQ ID NO: 535043
  misc_feature: HIJSMM301DV241.46.35.D02.1.454.light.4.raw

SEQ ID NO: 593217 - DNA, 505 bp, Homo sapiens; identical to SEQ ID NO: 535503
  misc_feature: HIJSMM301AOQLB.8.28.C06.1.454.light.4.raw

SEQ ID NO: 593218 - DNA, 486 bp, Homo sapiens; identical to SEQ ID NO: 535385
  misc_feature: HIJSMM301B3IXJ.19.71.G05.1.454.light.4.raw

SEQ ID NO: 593219 - DNA, 464 bp, Homo sapiens; identical to SEQ ID NO: 536640
  misc_feature: HIJSMM301CW9S6.26.78.H01.1.454.light.4.raw

SEQ ID NO: 593220 - DNA, 497 bp, Homo sapiens
  misc_feature: HIJSMM301CAO2E.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaagggaccagggtggaaagtcaaacgaaactgtggctgcaccatctgtcttcat

SEQ ID NO: 593221 - DNA, 498 bp, Homo sapiens
  misc_feature: HIJSMM301DKYHR.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagccaaggctgccccctcggtcactctcg

SEQ ID NO: 593222 - DNA, 487 bp, Homo sapiens
  misc_feature: HIJSMM301ATD83.41.44.D11.1.454.light.4.raw
tctatactatcacgaccggtgctcgatttagcgcagtacgaaggggcgtgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaa

SEQ ID NO: 593223 - DNA, 488 bp, Homo sapiens
  misc_feature: HIJSMM301ESA03.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagccaaggctgccccctcggtcact

SEQ ID NO: 593224 - DNA, 514 bp, Homo sapiens
  misc_feature: HIJSMM301ARXKE.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcattctgttcccgcctcctcg

SEQ ID NO: 593225 - DNA, 496 bp, Homo sapiens; identical to SEQ ID NO: 535109
  misc_feature: HIJSMM301CBVJW.16.78.H01.1.454.light.4.raw

SEQ ID NO: 593226 - DNA, 487 bp, Homo sapiens; identical to SEQ ID NO: 537009
  misc_feature: HIJSMM301CFKY3.12.88.H11.1.454.light.4.raw

SEQ ID NO: 593227 - DNA, 493 bp, Homo sapiens; identical to SEQ ID NO: 540903
  misc_feature: HIJSMM301ATEHF.10.20.B09.1.454.light.4.raw

SEQ ID NO: 593228 - DNA, 482 bp, Homo sapiens
  misc_feature: HIJSMM301A2RJB.3.14.B03.1.454.light.4.raw
agacgcactccacgaccggtgctcgatttagtgtgagtagttccgcggggacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagcccagccagcaataagaactacttaggttggtagcagcagaatccaggacagcctcctaagctgctcatttactgggcatctacccgggaatccggggtccctgaccgattcagtggcggcgggtctgggacagatttcactctcaccatcagcagcctgcaggctgctgaagtggcagctcattactgtcagcaatattatagtcctcctggtgaagttttggccaggggaccaagctggagatcaaacgaactgtggctgcaccatctgtctt

SEQ ID NO: 593229 - DNA, 516 bp, Homo sapiens
  misc_feature: HIJSMM301D1940.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacttcggtccacgggaccgaacggtaggaaagtacaaagacgaacgtacgtggcgtgcaccactctgtcttctactcttcccgt

SEQ ID NO: 593230 - DNA, 491 bp, Homo sapiens
  misc_feature: HIJSMM301BZZ82.52.27.C05.1.454.light.4.raw
cgcagtacgacacgaccggtgctcgatttagacgcgatcgaagggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttggggtgttcggcggagggaccaagttgaccgtcctaggtcagcccaaggctgccccccg

SEQ ID NO: 593231 - DNA, 501 bp, Homo sapiens
  misc_feature: HIJSMM301DBNNN.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaacccccgatcaccttcggccgaggggacacggcctggagattaaacgaactgtggctgcaccat

SEQ ID NO: 593232 - DNA, 510 bp, Homo sapiens
  misc_feature: HIJSMM301E2XTW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaagggaccaagggtagaaagtacaaaacgaactacgtggctggcaccatctgttcttctatccttccccg

SEQ ID NO: 593233 - DNA, 507 bp, Homo sapiens; identical to SEQ ID NO: 545328
  misc_feature: HIJSMM301DPUIM.8.33.C11.1.454.light.4.raw

SEQ ID NO: 593234 - DNA, 510 bp, Homo sapiens
  misc_feature: HIJSMM301CC5A0.49.87.H10.1.454.light.4.raw
  modified_base (238)..(238): a, c, t, g, unknown or other
agtcgagagacacgaccggtgctcgatttagcagtactgcgttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagntatgcttattggtaccatcagaagtcaggccaggcccctgtactggtcatctatgaggacaccaaacgaccctccgggatccctacgagattctctggctccagtttagggacagtggccaccctgacagtcagtgggcccaggtggaggatgagggtgattactactgttactcaacagacattactactactcataggtgttcggcggagggaccaagctgaccgtcctaggtcagcccaaggctgccccctcggtcactctgttccccg

SEQ ID NO: 593235 - DNA, 486 bp, Homo sapiens; identical to SEQ ID NO: 542293
  misc_feature: HIJSMM301ALDBF.41.10.A10.1.454.light.4.raw

SEQ ID NO: 593236 - DNA, 487 bp, Homo sapiens
  misc_feature: HIJSMM301DOSLU.43.4.A04.1.454.light.4.raw
tgtgagtagtcacgaccggtgctcgatttagagtagtgatcagggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggacatacaaacgaactgtggctgcacc

SEQ ID NO: 593237 - DNA, 502 bp, Homo sapiens
  misc_feature: HIJSMM301CMES1.3.33.C11.1.454.light.4.raw
  modified_base (456)..(456): a, c, t, g, unknown or other
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcacacggcctccctgaccatctctgggctccaggctgaggacgaggctgattatttctgcagctcatacacaaccggcaccactgtcgtggtttcggnggaggacaagctgaccgtcctaggtcagcccaaggcctgccctacg

SEQ ID NO: 593238 - DNA, 482 bp, Homo sapiens
  misc_feature: HIJSMM301BJV6R.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtcctaggtcc

SEQ ID NO: 593239 - DNA, 405 bp, Homo sapiens
  misc_feature: HIJSMM301A9322.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctcgttcccaccctcctcctacagtgct

SEQ ID NO: 593240 - DNA, 493 bp, Homo sapiens
  misc_feature: HIJSMM301B5NY7.16.6.A06.1.454.light.4.raw
  modified_base (440)..(440): a, c, t, g, unknown or other
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctntgacgttcggccaagggaccaaggtgagatcaaacgaactgtggctgcaccat

SEQ ID NO: 593241 - DNA, 495 bp, Homo sapiens
  misc_feature: HIJSMM301BESPM.19.71.G05.1.454.light.4.raw
  modified_base (432)..(432): a, c, t, g, unknown or other
  modified_base (484)..(484): a, c, t, g, unknown or other
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatcctacccgggaatccggggtccctgaccgattcagtggcagcgggtctgggacagatttcactctcaccatcagcagcctgcaggctgaagatgtggcagtttattatttgcaanatattattatacttcgtggacgttcggcaacgggaccaaggtgagtatacanacgaactgtgg

SEQ ID NO: 593242 - DNA, 515 bp, Homo sapiens
  misc_feature: HIJSMM301BFTFN.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagcctctcgtggttttcggcgggggaccaaggtgaccgtcctaagtcagcccaaggctgccccctcggtcactctgttcccgccctcct

SEQ ID NO: 593243 - DNA, 510 bp, Homo sapiens
  misc_feature: HIJSMM301D14CN.40.60.F05.1.454.light.4.raw
tctagcgactcacgaccggtgctcgatttagtacgtcatcagggaaagggcacgaccggtgctcgatttagtacgtcatcagggaaagggggaagagctgctcagttaggacccagagggaaccatggaaaccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcttcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaac

SEQ ID NO: 593244 - DNA, 414 bp, Homo sapiens
  misc_feature: HIJSMM301BBIG6.10.38.D05.1.454.light.4.raw
catagtagtgcacgaccggtgctcgatttagtatctgatagttggggtttggggtctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 593245 - DNA, 490 bp, Homo sapiens; identical to SEQ ID NO: 538999
  misc_feature: HIJSMM301BFJGO.16.86.H09.1.454.light.4.raw

SEQ ID NO: 593246 - DNA, 516 bp, Homo sapiens; identical to SEQ ID NO: 553885
  misc_feature: HIJSMM301D9C6F.22.36.D03.1.454.light.4.raw

SEQ ID NO: 593247 - DNA, 494 bp, Homo sapiens; identical to SEQ ID NO: 534992
  misc_feature: HIJSMM301BOPVJ.9.1.A01.1.454.light.4.raw

SEQ ID NO: 593248 - DNA, 505 bp, Homo sapiens
  misc_feature: HIJSMM301A6ZP6.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttcttatcctccgtggacgttcggccaagggaccgagggtggaaatcagacgaactgtggctgcaccat

SEQ ID NO: 593249 - DNA, 503 bp, Homo sapiens
  misc_feature: HIJSMM301APRW7.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagccaaggctgccccctcggtcactctgttcccgcct

SEQ ID NO: 593250 - DNA, 500 bp, Homo sapiens; identical to SEQ ID NO: 540219
  misc_feature: HIJSMM301A4L4E.43.34.D01.1.454.light.4.raw

SEQ ID NO: 593251 - DNA, 488 bp, Homo sapiens
  misc_feature: HIJSMM301BV0RI.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccat

SEQ ID NO: 593252 - DNA, 502 bp, Homo sapiens; identical to SEQ ID NO: 564875
  misc_feature: HIJSMM301CHRPR.48.36.D03.1.454.light.4.raw

SEQ ID NO: 593253 - DNA, 496 bp, Homo sapiens; identical to SEQ ID NO: 535109
  misc_feature: HIJSMM301EBE2P.16.78.H01.1.454.light.4.raw

SEQ ID NO: 593254 - DNA, 518 bp, Homo sapiens
  misc_feature: HIJSMM301BWTPU.41.33.C11.1.454.light.4.raw
tctatactatcacgaccggtgctcgatttagagtgagctcgttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctatcggcggagggacgaagctgaccgtcctgggtcagcccaaggctcgccccctcggtcactctcgttcccgccct

SEQ ID NO: 593255 - DNA, 500 bp, Homo sapiens; identical to SEQ ID NO: 540012
  misc_feature: HIJSMM301BHN3W.52.34.D01.1.454.light.4.raw

SEQ ID NO: 593256 - DNA, 503 bp, Homo sapiens
  misc_feature: HIJSMM301E03YI.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaacggctgccccctcggtcactc

SEQ ID NO: 593257 - DNA, 496 bp, Homo sapiens
  misc_feature: HIJSMM301CZOQE.13.67.G01.1.454.light.4.raw
  modified_base (486)..(486): a, c, t, g, unknown or other
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatatactcctccgaggctcaacttcgtcggagggaccgaaggtaggaggatnaaacgaaact

SEQ ID NO: 593258 - DNA, 494 bp, Homo sapiens
  misc_feature: HIJSMM301CL81M.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggtgggagggaccaaggtggagatcaaacgaactgtggctgcaccatctgtcttcta

SEQ ID NO: 593259 - DNA, 491 bp, Homo sapiens; identical to SEQ ID NO: 538021
  misc_feature: HIJSMM301AR9UO.3.72.G06.1.454.light.4.raw

SEQ ID NO: 593260 - DNA, 501 bp, Homo sapiens
  misc_feature: HIJSMM301DHXH1.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgactgtggctgcaccatctgtcttcatcttcccgcat

SEQ ID NO: 593261 - DNA, 447 bp, Homo sapiens; identical to SEQ ID NO: 535020
  misc_feature: HIJSMM301BK6T6.18.9.A09.1.454.light.4.raw

SEQ ID NO: 593262 - DNA, 507 bp, Homo sapiens
  misc_feature: HIJSMM301DJDCX.48.21.B10.1.454.light.4.raw
agtatacatacacgaccggtgctcgatttagtgtcgtcgcaaagagaggaggggggaagagctgctcagttaggacccagagggaaccatggaaaccccagcgcagcttctctttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggcaggggaccaaggtggaaatcaaacgaactgtggctgcaccatctgtcttcatcttcccg

SEQ ID NO: 593263 - DNA, 497 bp, Homo sapiens
  misc_feature: HIJSMM301CT3HI.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctactacttttggccaggggaccaaggctggagatcaaacgaactgtggctgca

SEQ ID NO: 593264 - DNA, 510 bp, Homo sapiens; identical to SEQ ID NO: 547100
  misc_feature: HIJSMM301CP0U7.48.23.C01.1.454.light.4.raw

SEQ ID NO: 593265 - DNA, 508 bp, Homo sapiens
  misc_feature: HIJSMM301D5PJK.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggtaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgccat

SEQ ID NO: 593266 - DNA, 510 bp, Homo sapiens
  misc_feature: HIJSMM301A0KJ4.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagacccccaccactcttgatttattgaagtcagtaagcggccctcaggggtttctagtcgcttctctgctccaagtctggcaacacggcctccctgacaatctctgggctccaggctgacgacgaggctgaatattactgcagctcatatgtagatggtgcctctttcaaggttttcggtcggagggaccaggctgaccgtcctaagtcagcccaaggctcgcccctccggt

SEQ ID NO: 593267 - DNA, 510 bp, Homo sapiens; identical to SEQ ID NO: 535474
  misc_feature: HIJSMM301DA7ZL.17.33.C11.1.454.light.4.raw

SEQ ID NO: 593268 - DNA, 463 bp, Homo sapiens; identical to SEQ ID NO: 535062
  misc_feature: HIJSMM301BZGF6.11.73.G07.1.454.light.4.raw

SEQ ID NO: 593269 - DNA, 447 bp, Homo sapiens; identical to SEQ ID NO: 535020
  misc_feature: HIJSMM301D99SS.18.9.A09.1.454.light.4.raw

SEQ ID NO: 593270 - DNA, 496 bp, Homo sapiens; identical to SEQ ID NO: 548004
  misc_feature: HIJSMM301BG5SD.3.35.D02.1.454.light.4.raw

SEQ ID NO: 593271 - DNA, 485 bp, Homo sapiens; identical to SEQ ID NO: 570229
  misc_feature: HIJSMM301B7RFL.47.60.F05.1.454.light.4.raw

SEQ ID NO: 593272 - DNA, 508 bp, Homo sapiens
  misc_feature: HIJSMM301CMY2A.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagttttattactgtcaacatcgtaccgagtggcctccgggggccactttcggccctgggaccaaaattgagatcaaacgaactgtggctgcaccatctgtcttcatcttcccgccact

SEQ ID NO: 593273 - DNA, 469 bp, Homo sapiens
  misc_feature: HIJSMM301C15YN.49.67.G01.1.454.light.4.raw
agtcgagagacacgaccggtgctcgatttagagtatacatattgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaa

SEQ ID NO: 593274 - DNA, 492 bp, Homo sapiens
  misc_feature: HIJSMM301EH7TL.49.38.D05.1.454.light.4.raw
agtcgagagacacgaccggtgctcgatttagtatctgatagttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 593275 - DNA, 508 bp, Homo sapiens; identical to SEQ ID NO: 536388
  misc_feature: HIJSMM301CACMC.11.57.F02.1.454.light.4.raw

SEQ ID NO: 593276 - DNA, 517 bp, Homo sapiens; identical to SEQ ID NO: 541047
  misc_feature: HIJSMM301BNS2L.49.10.A10.1.454.light.4.raw

SEQ ID NO: 593277 - DNA, 508 bp, Homo sapiens; identical to SEQ ID NO: 591695
  misc_feature: HIJSMM301AKB6B.43.3.A03.1.454.light.4.raw

SEQ ID NO: 593278 - DNA, 489 bp, Homo sapiens
  misc_feature: HIJSMM301CVFWI.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgacggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcaggcgtaacg

SEQ ID NO: 593279 - DNA, 478 bp, Homo sapiens
  misc_feature: HIJSMM301CQY5F.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgagatttgcaacttactattgtcaacaggctaacagtttccttaatcttcgccaaggacacgactggagattaaacgaactgtggctgcacc

SEQ ID NO: 593280 - DNA, 502 bp, Homo sapiens; identical to SEQ ID NO: 541971
  misc_feature: HIJSMM301CZU4A.4.39.D06.1.454.light.4.raw

SEQ ID NO: 593281 - DNA, 447 bp, Homo sapiens; identical to SEQ ID NO: 535201
  misc_feature: HIJSMM301B6KT5.18.9.A09.1.454.light.4.raw

SEQ ID NO: 593282 - DNA, 490 bp, Homo sapiens
  misc_feature: HIJSMM301EBJG3.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgatgatttggcaacttactactgccaaccgtatagtacttattcggtcaccttcggccaagggaccacgactggagattaaacgaa

SEQ ID NO: 593283 - DNA, 494 bp, Homo sapiens; identical to SEQ ID NO: 534994
  misc_feature: HIJSMM301A3UP6.27.78.H01.1.454.light.4.raw

SEQ ID NO: 593284 - DNA, 497 bp, Homo sapiens
  misc_feature: HIJSMM301D3NAE.48.27.C05.1.454.light.4.raw
agtatacatacacgaccggtgctcgatttagacgcgatcgaagggtttgggggaagagctgctcagttaggacccagagggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaacgaactgtggctgcaccatctgtctt

SEQ ID NO: 593285 - DNA, 496 bp, Homo sapiens; identical to SEQ ID NO: 535109
  misc_feature: HIJSMM301C36ET.16.78.H01.1.454.light.4.raw

SEQ ID NO: 593286 - DNA, 522 bp, Homo sapiens
  misc_feature: HIJSMM301BNUCF.52.57.F02.1.454.light.4.raw
cgcagtacgacacgaccggtgctcgatttagctcgatatagttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccggtcctacgtcagcccaaggctgccccctcggtcactctgttccccg

SEQ ID NO: 593287 - DNA, 481 bp, Homo sapiens
  misc_feature: HIJSMM301BO7YY.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctggaccaatgtggatatcaaacgaactgtggctgcaccatctgtctt

SEQ ID NO: 593288 - DNA, 530 bp, Homo sapiens
  misc_feature: HIJSMM301BO6Y1.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaaggtacgaaacgaaactagtaggcgtgcgaccactctgtcttctactcttcccgtcccactctcgat

SEQ ID NO: 593289 - DNA, 506 bp, Homo sapiens
  misc_feature: HIJSMM301BEAAH.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttggatcgcagcctgactgcttacgtcttcggagctgggaccaaggtcaccgtcctaggtcagcccaaggccaacccc

SEQ ID NO: 593290 - DNA, 489 bp, Homo sapiens; identical to SEQ ID NO: 535139
  misc_feature: HIJSMM301A79MR.14.55.E11.1.454.light.4.raw

SEQ ID NO: 593291 - DNA, 488 bp, Homo sapiens; identical to SEQ ID NO: 537260
  misc_feature: HIJSMM301BKDY5.47.70.G04.1.454.light.4.raw

SEQ ID NO: 593292 - DNA, 513 bp, Homo sapiens; identical to SEQ ID NO: 568964
  misc_feature: HIJSMM301AU4UR.8.23.C01.1.454.light.4.raw

SEQ ID NO: 593293 - DNA, 484 bp, Homo sapiens; identical to SEQ ID NO: 544700
  misc_feature: HIJSMM301AKNIU.41.78.H01.1.454.light.4.raw

SEQ ID NO: 593294 - DNA, 496 bp, Homo sapiens; identical to SEQ ID NO: 542070
  misc_feature: HIJSMM301A6TNX.22.14.B03.1.454.light.4.raw

SEQ ID NO: 593295 - DNA, 487 bp, Homo sapiens
  misc_feature: HIJSMM301CWJYE.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaaggttggagatcaaacgaa

SEQ ID NO: 593296 - DNA, 487 bp, Homo sapiens; identical to SEQ ID NO: 535583
  misc_feature: HIJSMM301APG83.22.73.G07.1.454.light.4.raw

SEQ ID NO: 593297 - DNA, 490 bp, Homo sapiens; identical to SEQ ID NO: 535234
  misc_feature: HIJSMM301EWIW1.17.21.B10.1.454.light.4.raw

SEQ ID NO: 593298 - DNA, 505 bp, Homo sapiens; identical to SEQ ID NO: 536254
  misc_feature: HIJSMM301EUB3C.7.71.G05.1.454.light.4.raw

SEQ ID NO: 593299 - DNA, 503 bp, Homo sapiens
  misc_feature: HIJSMM301BDUD4.48.53.E09.1.454.light.4.raw
agtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 593300 - DNA, 491 bp, Homo sapiens
  misc_feature: HIJSMM301C4EF2.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattatttgcatgcaagcaacacactggccgtacacttttggccaggggaccaagctggagatcaatcgaactgt

SEQ ID NO: 593301 - DNA, 485 bp, Homo sapiens; identical to SEQ ID NO: 545103
  misc_feature: HIJSMM301AS7OY.5.42.D09.1.454.light.4.raw

SEQ ID NO: 593302 - DNA, 495 bp, Homo sapiens
  misc_feature: HIJSMM301EHYH6.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaaggaactgtggctgcaccatctgtcttcatcttccccg

SEQ ID NO: 593303 - DNA, 488 bp, Homo sapiens; identical to SEQ ID NO: 542699
  misc_feature: HIJSMM301DCZHS.12.51.E07.1.454.light.4.raw

SEQ ID NO: 593304 - DNA, 521 bp, Homo sapiens; identical to SEQ ID NO: 539470
  misc_feature: HIJSMM301CCJK5.27.23.C01.1.454.light.4.raw

SEQ ID NO: 593305 - DNA, 522 bp, Homo sapiens
  misc_feature: HIJSMM301A6PNE.7.86.H09.1.454.light.4.raw
cgtgtctctacacgaccggtgctcgatttagtgctatagacttgggtttgggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccaagtgaaccttttagtagtagttatttagccttggtatcggcaaaaacctggccaggctccccgactcctcttctttggtggagcctacagggccactggcaccccagacaggatcagtggcagcgggtctgggacagacttcattctcaccatcaacaagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 593306 - DNA, 494 bp, Homo sapiens; identical to SEQ ID NO: 535478
  misc_feature: HIJSMM301A3J18.10.79.H02.1.454.light.4.raw

SEQ ID NO: 593307 - DNA, 482 bp, Homo sapiens
  misc_feature: HIJSMM301ED6JJ.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcgcgaggaccgaaggtggagatcaaacgaaactagtggctgcaccat

SEQ ID NO: 593308 - DNA, 464 bp, Homo sapiens; identical to SEQ ID NO: 539492
  misc_feature: HIJSMM301BVB0L.18.59.F04.1.454.light.4.raw

SEQ ID NO: 593309 - DNA, 523 bp, Homo sapiens
  misc_feature: HIJSMM301CDA8L.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcggggggacgtcgacgttgaccggtcctaggtcagcccaaggctcgccccctcggtcactctgttcccgccctcctcacta

SEQ ID NO: 593310 - DNA, 504 bp, Homo sapiens
  misc_feature: HIJSMM301BMNY6.4.71.G05.1.454.light.4.raw
  modified_base (237)..(237): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 593311 - DNA, 482 bp, Homo sapiens; identical to SEQ ID NO: 562591
  misc_feature: HIJSMM301C49GO.49.83.H06.1.454.light.4.raw

SEQ ID NO: 593312 - DNA, 498 bp, Homo sapiens
  misc_feature: HIJSMM301BDTLL.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaatcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaa

SEQ ID NO: 593313 - DNA, 514 bp, Homo sapiens; identical to SEQ ID NO: 554167
  misc_feature: HIJSMM301A35KC.40.12.B01.1.454.light.4.raw

SEQ ID NO: 593314 - DNA, 503 bp, Homo sapiens
  misc_feature: HIJSMM301A5UGE.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagacagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtca

SEQ ID NO: 593315 - DNA, 520 bp, Homo sapiens; identical to SEQ ID NO: 579367
  misc_feature: HIJSMM301DL83U.27.23.C01.1.454.light.4.raw

SEQ ID NO: 593316 - DNA, 482 bp, Homo sapiens
  misc_feature: HIJSMM301A9OJ1.3.10.A10.1.454.light.4.raw
agacgcactccacgaccggtgctcgatttagcgtcgatctcagggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccagggtcaccgtctaggtcagcccaaggccaa

SEQ ID NO: 593317 - DNA, 486 bp, Homo sapiens; identical to SEQ ID NO: 535043
  misc_feature: HIJSMM301EJC6I.46.35.D02.1.454.light.4.raw

SEQ ID NO: 593318 - DNA, 495 bp, Homo sapiens; identical to SEQ ID NO: 542753
  misc_feature: HIJSMM301CM977.22.14.B03.1.454.light.4.raw

SEQ ID NO: 593319 - DNA, 487 bp, Homo sapiens
  misc_feature: HIJSMM301DM7YT.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcaagcagagtggaggctgaggatgttggggttattactgcatgcaagctctacaaactccttacacttttggccaggggaccaagctggagatcaaacgaa

SEQ ID NO: 593320 - DNA, 505 bp, Homo sapiens
  misc_feature: HIJSMM301AFZVI.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtca

SEQ ID NO: 593321 - DNA, 503 bp, Homo sapiens
  misc_feature: HIJSMM301DPEQO.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtccaggtcagcccaaggcccaacccca

SEQ ID NO: 593322 - DNA, 499 bp, Homo sapiens; identical to SEQ ID NO: 535899
  misc_feature: HIJSMM301AHIZK.19.78.H01.1.454.light.4.raw

SEQ ID NO: 593323 - DNA, 479 bp, Homo sapiens
  misc_feature: HIJSMM301EVII7.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaagtaggatagtcaaccgaactgtggctgcaccta

SEQ ID NO: 593324 - DNA, 375 bp, Homo sapiens
  misc_feature: HIJSMM301A7XO1.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 593325 - DNA, 501 bp, Homo sapiens; identical to SEQ ID NO: 550389
  misc_feature: HIJSMM301AYEZL.40.53.E09.1.454.light.4.raw

SEQ ID NO: 593326 - DNA, 509 bp, Homo sapiens; identical to SEQ ID NO: 543772
  misc_feature: HIJSMM301EAI3S.2.21.B10.1.454.light.4.raw

SEQ ID NO: 593327 - DNA, 502 bp, Homo sapiens
  misc_feature: HIJSMM301DVUL7.21.22.B11.1.454.light.4.raw
  modified_base (428)..(428): a, c, t, g, unknown or other
  modified_base (460)..(460): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggagcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtnttcggcggagggaccaaactgaccgtcctaggtcagccccaa

SEQ ID NO: 593328 - DNA, 520 bp, Homo sapiens; identical to SEQ ID NO: 539176
  misc_feature: HIJSMM301DM4DN.27.23.C01.1.454.light.4.raw

SEQ ID NO: 593329 - DNA, 497 bp, Homo sapiens; identical to SEQ ID NO: 535740
  misc_feature: HIJSMM301AQFCQ.3.71.G05.1.454.light.4.raw

SEQ ID NO: 593330 - DNA, 511 bp, Homo sapiens
  misc_feature: HIJSMM301EVV5W.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcgcggagggaccaagctgaccgtcctaggtcagcccaaggctgccccctggtcactctgttccca

SEQ ID NO: 593331 - DNA, 514 bp, Homo sapiens; identical to SEQ ID NO: 572493
  misc_feature: HIJSMM301DYHK2.16.66.F11.1.454.light.4.raw

SEQ ID NO: 593332 - DNA, 502 bp, Homo sapiens
  misc_feature: HIJSMM301BNEGQ.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgactgtggctgcaccatctgtcttcatcttcccgc

SEQ ID NO: 593333 - DNA, 499 bp, Homo sapiens; identical to SEQ ID NO: 550492
  misc_feature: HIJSMM301DUPH1.43.66.F11.1.454.light.4.raw

SEQ ID NO: 593334 - DNA, 493 bp, Homo sapiens; identical to SEQ ID NO: 551874
  misc_feature: HIJSMM301CUWVK.18.11.A11.1.454.light.4.raw

SEQ ID NO: 593335 - DNA, 477 bp, Homo sapiens
  misc_feature: HIJSMM301AWV80.40.1.A01.1.454.light.4.raw
tctagcgactcacgaccggtgctcgatttagacgtctcatcaggggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgtttttggtccaggggaccaaggtggagatcaaacgaactagtggctgcaccat

SEQ ID NO: 593336 - DNA, 461 bp, Homo sapiens
  misc_feature: HIJSMM301AMOPE.49.8.A08.1.454.light.4.raw
agtcgagagacacgaccggtgctcgatttagcatactctacaggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 593337 - DNA, 504 bp, Homo sapiens; identical to SEQ ID NO: 555616
  misc_feature: HIJSMM301B9BNT.5.86.H09.1.454.light.4.raw

SEQ ID NO: 593338 - DNA, 517 bp, Homo sapiens
  misc_feature: HIJSMM301BVIDA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaaggaccgaaggtaggaaggtacaaacgaactacgtggcgtgcaccactctgtcttctatcttcccgtccact

SEQ ID NO: 593339 - DNA, 519 bp, Homo sapiens
  misc_feature: HIJSMM301B8X2N.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttccgccct

SEQ ID NO: 593340 - DNA, 504 bp, Homo sapiens
  misc_feature: HIJSMM301EJXXM.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctcgtccccccg

SEQ ID NO: 593341 - DNA, 504 bp, Homo sapiens; identical to SEQ ID NO: 557936
  misc_feature: HIJSMM301AZZPN.19.78.H01.1.454.light.4.raw

SEQ ID NO: 593342 - DNA, 491 bp, Homo sapiens; identical to SEQ ID NO: 535294
  misc_feature: HIJSMM301ARCSM.16.68.G02.1.454.light.4.raw

SEQ ID NO: 593343 - DNA, 471 bp, Homo sapiens
  misc_feature: HIJSMM301C4EF5.49.4.A04.1.454.light.4.raw
agtcgagagacacgaccggtgctcgatttagagtagtgatcagggggtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccgaaggtggagatcaagcgaactgtggctgca

SEQ ID NO: 593344 - DNA, 504 bp, Homo sapiens; identical to SEQ ID NO: 553137
  misc_feature: HIJSMM301B46OH.22.21.B10.1.454.light.4.raw

SEQ ID NO: 593345 - DNA, 478 bp, Homo sapiens
  misc_feature: HIJSMM301DRZBI.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggtcaggggaccaaagctggagaggaaacgaactgtggctgcaccat

SEQ ID NO: 593346 - DNA, 505 bp, Homo sapiens; identical to SEQ ID NO: 535503
  misc_feature: HIJSMM301DEIAP.8.28.C06.1.454.light.4.raw

SEQ ID NO: 593347 - DNA, 521 bp, Homo sapiens
  misc_feature: HIJSMM301BSJ7V.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattaatgtgataattgcggagggaccaagggtgaccgtcctacgtcagccaaaggctgccccctccggtcactctgttcccta

SEQ ID NO: 593348 - DNA, 503 bp, Homo sapiens
  misc_feature: HIJSMM301A9CKG.18.78.H01.1.454.light.4.raw
tacgagtatgcacgaccggtgctcgatttagtgtgagtagtttgggtttgggggggctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccatgtca

SEQ ID NO: 593349 - DNA, 516 bp, Homo sapiens
  misc_feature: HIJSMM301DH5EA.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaccgaacggtaggaaatacaaacgaaactagtggcgtgcgaccactctgtcttctactcttccccg

SEQ ID NO: 593350 - DNA, 507 bp, Homo sapiens; identical to SEQ ID NO: 563344
  misc_feature: HIJSMM301EGV3U.3.79.H02.1.454.light.4.raw

SEQ ID NO: 593351 - DNA, 489 bp, Homo sapiens
  misc_feature: HIJSMM301AMGNE.5.23.C01.1.454.light.4.raw
atcagacacgcacgaccggtgctcgatttagtacacgtgattagggattggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttattactgtcaacagagttacgatacccctccgctcactttcggcggagggaccaaggtggagatcaaacgaactgtggctgcaccatctgtctt

SEQ ID NO: 593352 - DNA, 507 bp, Homo sapiens
  misc_feature: HIJSMM301EOXYA.17.87.H10.1.454.light.4.raw
  modified_base (457)..(457): a, c, t, g, unknown or other
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggnggcaccaaggtgaccgtcctaggtcagcccaaggctgccccctcggtcta

SEQ ID NO: 593353 - DNA, 519 bp, Homo sapiens
  misc_feature: HIJSMM301DVG73.13.33.C11.1.454.light.4.raw
tcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctcaggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccaccctcctctatacgt

SEQ ID NO: 593354 - DNA, 494 bp, Homo sapiens; identical to SEQ ID NO: 534992
  misc_feature: HIJSMM301AD5S6.9.1.A01.1.454.light.4.raw

SEQ ID NO: 593355 - DNA, 507 bp, Homo sapiens
  misc_feature: HIJSMM301B6FLO.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttctat

SEQ ID NO: 593356 - DNA, 444 bp, Homo sapiens; identical to SEQ ID NO: 534993
  misc_feature: HIJSMM301DMNCV.5.9.A09.1.454.light.4.raw

SEQ ID NO: 593357 - DNA, 498 bp, Homo sapiens
  misc_feature: HIJSMM301CFO3J.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagaccgttcggaccaagggaccaaggtggaaatcaaacgaactgtggctgcacc

SEQ ID NO: 593358 - DNA, 489 bp, Homo sapiens
  misc_feature: HIJSMM301AIHD8.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcaagcagacaacagtaatacttatctttatgtcttcggatctgggaccagggtcacgtcctaggtcagcccaaggccaacccc

SEQ ID NO: 593359 - DNA, 385 bp, Homo sapiens
  misc_feature: HIJSMM301BIYXJ.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccgaaggtggagatcaaacgaaactgtggctgcaccatctgtcttcatcttcccgccatctgaatagtataga

SEQ ID NO: 593360 - DNA, 476 bp, Homo sapiens
  misc_feature: HIJSMM301D3H6A.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggaccagtcccctgtgctggtcatctatcaagatgccaagcggccctcagggatccctgagcgattctctggctccaactctgggaactcagccactctgaccatcagcgggacccaggctatggatgaggctgactattactgtcaggagtgggacagcagcactgcccgctatgtcttcggaactgggaccaaggtcaccgtcctaagtcagacccc

SEQ ID NO: 593361 - DNA, 495 bp, Homo sapiens
  misc_feature: HIJSMM301A2CYH.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgaccaaggtcaccgtcctgggtcagcccaaggcccaaccccactgcact

SEQ ID NO: 593362 - DNA, 417 bp, Homo sapiens
  misc_feature: HIJSMM301CPI3Y.19.86.H09.1.454.light.4.raw
tactctcgtgcacgaccggtgctcgatttagtgctatagacttgggtttgggggccgttcctgggactttctgataccacatcacaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 593363 - DNA, 515 bp, Homo sapiens
  misc_feature: HIJSMM301BZIGQ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtggttcggcggagggaccaagctggccgtcctaggtcagcccaaggctgccccctcggtcactctgttcccaccctcctcgagtagtaca

SEQ ID NO: 593364 - DNA, 510 bp, Homo sapiens
  misc_feature: HIJSMM301EXHFX.48.33.C11.1.454.light.4.raw
agtatacatacacgaccggtgctcgatttagagtgagctcgttgggtttggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccccg

SEQ ID NO: 593365 - DNA, 517 bp, Homo sapiens; identical to SEQ ID NO: 538903
  misc_feature: HIJSMM301CO1G3.41.25.C03.1.454.light.4.raw

SEQ ID NO: 593366 - DNA, 488 bp, Homo sapiens
  misc_feature: HIJSMM301A8XMQ.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcgtcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtcttgagtcagcccaaggccaa

SEQ ID NO: 593367 - DNA, 496 bp, Homo sapiens
  misc_feature: HIJSMM301EM3CF.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccgagggtggagatcaaacgaactgtggctgcaccatctgtcttcatcc

SEQ ID NO: 593368 - DNA, 492 bp, Homo sapiens; identical to SEQ ID NO: 540973
  misc_feature: HIJSMM301ADZH5.43.20.B09.1.454.light.4.raw

SEQ ID NO: 593369 - DNA, 502 bp, Homo sapiens
  misc_feature: HIJSMM301B743Y.43.38.D05.1.454.light.4.raw
tgtgagtagtcacgaccggtgctcgatttagtatctgatagttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaaccccac

SEQ ID NO: 593370 - DNA, 485 bp, Homo sapiens; identical to SEQ ID NO: 579022
  misc_feature: HIJSMM301AWFS1.7.75.G09.1.454.light.4.raw

SEQ ID NO: 593371 - DNA, 499 bp, Homo sapiens; identical to SEQ ID NO: 535698
  misc_feature: HIJSMM301DZXOL.12.86.H09.1.454.light.4.raw

SEQ ID NO: 593372 - DNA, 509 bp, Homo sapiens
  misc_feature: HIJSMM301CX5Q6.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtccccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaagggtggagatcaaacgaactgtggctgcaccatctgtctt

SEQ ID NO: 593373 - DNA, 487 bp, Homo sapiens; identical to SEQ ID NO: 536536
  misc_feature: HIJSMM301CKMOU.26.45.E01.1.454.light.4.raw

SEQ ID NO: 593374 - DNA, 514 bp, Homo sapiens; identical to SEQ ID NO: 538885
  misc_feature: HIJSMM301A5X9V.14.19.B08.1.454.light.4.raw

SEQ ID NO: 593375 - DNA, 473 bp, Homo sapiens; identical to SEQ ID NO: 557480
  misc_feature: HIJSMM301A16PM.18.76.G10.1.454.light.4.raw

SEQ ID NO: 593376 - DNA, 485 bp, Homo sapiens; identical to SEQ ID NO: 538533
  misc_feature: HIJSMM301DJCZG.47.78.H01.1.454.light.4.raw

SEQ ID NO: 593377 - DNA, 496 bp, Homo sapiens
  misc_feature: HIJSMM301ASL4J.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagatcggcccccaagctcctcatctatagaaattatgaacggtcctcaggggtccctgaccgattctctggctccaagtctggcacctcagcctccctggccatcagtgggctccggtccgaggatgaggctgattatactgtgttggatgggacagcagcctgagtgcttatgtcttcggaactgggaccacggtcaccgtcct

SEQ ID NO: 593378 - DNA, 488 bp, Homo sapiens; identical to SEQ ID NO: 535861
  misc_feature: HIJSMM301D9XZC.14.55.E11.1.454.light.4.raw

SEQ ID NO: 593379 - DNA, 474 bp, Homo sapiens; identical to SEQ ID NO: 561309
  misc_feature: HIJSMM301DWPG3.5.12.B01.1.454.light.4.raw

SEQ ID NO: 593380 - DNA, 506 bp, Homo sapiens; identical to SEQ ID NO: 545686
  misc_feature: HIJSMM301B83S4.18.37.D04.1.454.light.4.raw

SEQ ID NO: 593381 - DNA, 491 bp, Homo sapiens
  misc_feature: HIJSMM301D2I0O.48.10.A10.1.454.light.4.raw
agtatacatacacgaccggtgctcgatttagcgtcgatctcagggcacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcacttatttctgccaacagtatcatacttattctcggaccttcggccaagggaccgagggtggtaaacg

SEQ ID NO: 593382 - DNA, 472 bp, Homo sapiens
  misc_feature: HIJSMM301COHD2.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaaggaccgaaggtggaaatcaaacgaa

SEQ ID NO: 593383 - DNA, 501 bp, Homo sapiens; identical to SEQ ID NO: 550971
  misc_feature: HIJSMM301D1XQC.12.26.C04.1.454.light.4.raw

SEQ ID NO: 593384 - DNA, 492 bp, Homo sapiens; identical to SEQ ID NO: 549170
  misc_feature: HIJSMM301CX76I.40.81.H04.1.454.light.4.raw

SEQ ID NO: 593385 - DNA, 494 bp, Homo sapiens; identical to SEQ ID NO: 534994
  misc_feature: HIJSMM301DQU9Q.27.78.H01.1.454.light.4.raw

SEQ ID NO: 593386 - DNA, 418 bp, Homo sapiens; identical to SEQ ID NO: 536277
  misc_feature: HIJSMM301CFUOV.19.86.H09.1.454.light.4.raw

SEQ ID NO: 593387 - DNA, 513 bp, Homo sapiens
  misc_feature: HIJSMM301DPS5Q.17.28.C06.1.454.light.4.raw
cgtagactagcacgaccggtgctcgatttagagctcacgtattgggtttggggagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccacct

SEQ ID NO: 593388 - DNA, 503 bp, Homo sapiens; identical to SEQ ID NO: 539069
  misc_feature: HIJSMM301BZ63E.48.26.C04.1.454.light.4.raw

SEQ ID NO: 593389 - DNA, 500 bp, Homo sapiens
  misc_feature: HIJSMM301AU7X6.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactgtggctgcaccatctgtcttcatccttcccg

SEQ ID NO: 593390 - DNA, 464 bp, Homo sapiens
  misc_feature: HIJSMM301AZFHN.3.20.B09.1.454.light.4.raw
agacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaa

SEQ ID NO: 593391 - DNA, 482 bp, Homo sapiens; identical to SEQ ID NO: 540521
  misc_feature: HIJSMM301AX272.21.25.C03.1.454.light.4.raw

SEQ ID NO: 593392 - DNA, 492 bp, Homo sapiens; identical to SEQ ID NO: 535126
  misc_feature: HIJSMM301DPZYF.18.11.A11.1.454.light.4.raw

SEQ ID NO: 593393 - DNA, 517 bp, Homo sapiens; identical to SEQ ID NO: 555770
  misc_feature: HIJSMM301B1PSL.27.23.C01.1.454.light.4.raw

SEQ ID NO: 593394 - DNA, 486 bp, Homo sapiens; identical to SEQ ID NO: 535043
  misc_feature: HIJSMM301EKQU7.46.35.D02.1.454.light.4.raw

SEQ ID NO: 593395 - DNA, 485 bp, Homo sapiens
  misc_feature: HIJSMM301ECQ3E.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgacggatgttgggctctattattgcatgcaagctctacaagtcccgctcactttcggcggagggaccaaggtggagatcaaacgaa

SEQ ID NO: 593396 - DNA, 500 bp, Homo sapiens
  misc_feature: HIJSMM301CJT99.52.78.H01.1.454.light.4.raw
  modified_base (419)..(419): a, c, t, g, unknown or other
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaaacngacagtagtggtacttatgtgcagttcggcggagggaccaagcctgaccgtcctaggtcagcccaaggctgccccctcggt

SEQ ID NO: 593397 - DNA, 494 bp, Homo sapiens; identical to SEQ ID NO: 534994
  misc_feature: HIJSMM301E11FV.27.78.H01.1.454.light.4.raw

SEQ ID NO: 593398 - DNA, 514 bp, Homo sapiens
  misc_feature: HIJSMM301CISKU.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagccccaaggctgccccctcggtcactctgttcccgccctcctcgctacgtaga

SEQ ID NO: 593399 - DNA, 485 bp, Homo sapiens; identical to SEQ ID NO: 550890
  misc_feature: HIJSMM301AG9LS.52.69.G03.1.454.light.4.raw

SEQ ID NO: 593400 - DNA, 498 bp, Homo sapiens
  misc_feature: HIJSMM301CAUYL.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatggtagtgccatttctgctgtgttcggaggaggcacccggctgaccgtcctcggtcagcccaagctgccccatc

SEQ ID NO: 593401 - DNA, 516 bp, Homo sapiens
  misc_feature: HIJSMM301DENWT.48.37.D04.1.454.light.4.raw
agtatacatacacgaccggtgctcgatttagtagcatactgttgggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgattttattgtgctgtttgggatgacgacatgaatggttcgattttcggcggagggaccaaactgaccgtcccgggtcagcccaaggctgccccctcggtcactc

SEQ ID NO: 593402 - DNA, 495 bp, Homo sapiens
  misc_feature: HIJSMM301CKLAD.48.63.F08.1.454.light.4.raw
agtatacatacacgaccggtgctcgatttagcgatcgtataaggggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacactttggccaggggactaagctggagatcaaacgaactgtggctgcaccatctgtcttcatcttccccg

SEQ ID NO: 593403 - DNA, 520 bp, Homo sapiens; identical to SEQ ID NO: 557135
  misc_feature: HIJSMM301CPKFG.10.86.H09.1.454.light.4.raw

SEQ ID NO: 593404 - DNA, 494 bp, Homo sapiens
  misc_feature: HIJSMM301AWN9G.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttccc

SEQ ID NO: 593405 - DNA, 485 bp, Homo sapiens; identical to SEQ ID NO: 535606
  misc_feature: HIJSMM301AZAVL.47.46.E02.1.454.light.4.raw

SEQ ID NO: 593406 - DNA, 478 bp, Homo sapiens; identical to SEQ ID NO: 543744
  misc_feature: HIJSMM301AR99R.26.72.G06.1.454.light.4.raw

SEQ ID NO: 593407 - DNA, 501 bp, Homo sapiens
  misc_feature: HIJSMM301AZRHR.11.59.F04.1.454.light.4.raw
cgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactcg

SEQ ID NO: 593408 - DNA, 515 bp, Homo sapiens; identical to SEQ ID NO: 538755
  misc_feature: HIJSMM301CWPGP.14.70.G04.1.454.light.4.raw

SEQ ID NO: 593409 - DNA, 482 bp, Homo sapiens
  misc_feature: HIJSMM301CH8EL.49.81.H04.1.454.light.4.raw
agtcgagagacacgaccggtgctcgatttagtagtgtagattcgcgggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactagtggctgcaccat

SEQ ID NO: 593410 - DNA, 504 bp, Homo sapiens
  misc_feature: HIJSMM301AHBS9.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggcctgccccccg

SEQ ID NO: 593411 - DNA, 457 bp, Homo sapiens
  misc_feature: HIJSMM301CHSET.19.71.G05.1.454.light.4.raw
tactctcgtgcacgaccggtgctcgatttagtgtcgtcgcaagagagagggggcacttctccctctaacactctccccagtctccagactccctggctgtgtctctgggcgaggcgggccaccatcaactgcaagtccagccacaatcttttatacagttccaacaatgaaaactacttagcttggtaccagcagagaccaggacagcctcctaggctgctcatttactgggcatctacccgggaatccgggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 593412 - DNA, 520 bp, Homo sapiens; identical to SEQ ID NO: 539176
  misc_feature: HIJSMM301EM3FK.27.23.C01.1.454.light.4.raw

SEQ ID NO: 593413 - DNA, 483 bp, Homo sapiens
  misc_feature: HIJSMM301COPO5.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccaacggtggaaatcaaacgaactagtggctgcacca

SEQ ID NO: 593414 - DNA, 484 bp, Homo sapiens; identical to SEQ ID NO: 548783
  misc_feature: HIJSMM301A0O2H.13.55.E11.1.454.light.4.raw

SEQ ID NO: 593415 - DNA, 517 bp, Homo sapiens; identical to SEQ ID NO: 562910
  misc_feature: HIJSMM301AH5C5.41.25.C03.1.454.light.4.raw

SEQ ID NO: 593416 - DNA, 470 bp, Homo sapiens
  misc_feature: HIJSMM301DWWSN.49.53.E09.1.454.light.4.raw
agtcgagagacacgaccggtgctcgatttagagagagtgtgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcagactgcagcctgaagatattgcaaacatattactgtcaacagtatgataatctcccgctcactttcggcggagggaccaaggtggagatcaaacgaa

SEQ ID NO: 593417 - DNA, 454 bp, Homo sapiens; identical to SEQ ID NO: 535005
  misc_feature: HIJSMM301CQQWL.19.86.H09.1.454.light.4.raw

SEQ ID NO: 593418 - DNA, 514 bp, Homo sapiens; identical to SEQ ID NO: 541418
  misc_feature: HIJSMM301A71OS.17.33.C11.1.454.light.4.raw

SEQ ID NO: 593419 - DNA, 502 bp, Homo sapiens
  misc_feature: HIJSMM301APC0T.7.71.G05.1.454.light.4.raw
cgtgtctctacacgaccggtgctcgatttagtgtcgtcgcaagagagaggggggaggaactgctcagttaggacacagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtaggatatcaaacgaaactgtggctgcaccatct

SEQ ID NO: 593420 - DNA, 524 bp, Homo sapiens
  misc_feature: HIJSMM301E1XND.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgtttcggcggcgggaccaaaggtgaccgtcctaaggtcagcccaaggctgccccctcggtcactctgttcccaccct

SEQ ID NO: 593421 - DNA, 496 bp, Homo sapiens; identical to SEQ ID NO: 580201
  misc_feature: HIJSMM301EJ85Q.16.70.G04.1.454.light.4.raw

SEQ ID NO: 593422 - DNA, 492 bp, Homo sapiens
  misc_feature: HIJSMM301B3YX7.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggacccagggtggagatcagacgaactgtggctgcaccatctgtt

SEQ ID NO: 593423 - DNA, 475 bp, Homo sapiens; identical to SEQ ID NO: 560950
  misc_feature: HIJSMM301DJT1Q.5.12.B01.1.454.light.4.raw

SEQ ID NO: 593424 - DNA, 504 bp, Homo sapiens
  misc_feature: HIJSMM301CK4UN.51.46.E02.1.454.light.4.raw
  modified_base (248)..(248): a, c, t, g, unknown or other
cgatcgtatacacgaccggtgctcgatttagactcatctacagggaaagggggatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacncctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccatctgtctt

SEQ ID NO: 593425 - DNA, 499 bp, Homo sapiens
  misc_feature: HIJSMM301B5N40.3.33.C11.1.454.light.4.raw
  modified_base (439)..(439): a, c, t, g, unknown or other
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaanactgttttcggcggagggaccaagctgaccgtcctaggtcagcccaaggctgtccccccg

SEQ ID NO: 593426 - DNA, 503 bp, Homo sapiens
  misc_feature: HIJSMM301CNQ3B.48.15.B04.1.454.light.4.raw
agtatacatacacgaccggtgctcgatttagacagtatatatccgcgggcacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctccctactttcggcggtagggaccagggtggacgtaccg

SEQ ID NO: 593427 - DNA, 472 bp, Homo sapiens
  misc_feature: HIJSMM301DRJVJ.52.23.C01.1.454.light.4.raw
cgcagtacgacacgaccggtgctcgatttagtacacgtgattagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctcacacgttcggccaagggccaagctggaaatcaaacgaa

SEQ ID NO: 593428 - DNA, 492 bp, Homo sapiens
  misc_feature: HIJSMM301A8B73.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattcactttcggccctgggaccaagtggatttcagacgaactgtggctgcaccatctgtcttcta

SEQ ID NO: 593429 - DNA, 505 bp, Homo sapiens; identical to SEQ ID NO: 536437
  misc_feature: HIJSMM301CQ226.18.37.D04.1.454.light.4.raw

SEQ ID NO: 593430 - DNA, 504 bp, Homo sapiens
  misc_feature: HIJSMM301AF7CS.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggactaaggtcaccgtcctaggtcagcccaaggccaaccccactgtca

SEQ ID NO: 593431 - DNA, 517 bp, Homo sapiens; identical to SEQ ID NO: 539798
  misc_feature: HIJSMM301CC6VH.14.70.G04.1.454.light.4.raw

SEQ ID NO: 593432 - DNA, 488 bp, Homo sapiens; identical to SEQ ID NO: 582907
  misc_feature: HIJSMM301ESZP7.4.33.C11.1.454.light.4.raw

SEQ ID NO: 593433 - DNA, 505 bp, Homo sapiens
  misc_feature: HIJSMM301ENWWM.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 593434 - DNA, 506 bp, Homo sapiens
  misc_feature: HIJSMM301DNRYQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatcaaaacgaactagtggctgcaccatctgtcttctatcttccccg

SEQ ID NO: 593435 - DNA, 487 bp, Homo sapiens; identical to SEQ ID NO: 536206
  misc_feature: HIJSMM301B2JAL.47.38.D05.1.454.light.4.raw

SEQ ID NO: 593436 - DNA, 511 bp, Homo sapiens
  misc_feature: HIJSMM301B43GU.19.72.G06.1.454.light.4.raw
tactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatggggtgtgcgggcgggagggaccaaggtgaccgtcctgggtcaggcccaaggctgccccctcggtcact

SEQ ID NO: 593437 - DNA, 483 bp, Homo sapiens; identical to SEQ ID NO: 572112
  misc_feature: HIJSMM301CUILP.10.1.A01.1.454.light.4.raw

SEQ ID NO: 593438 - DNA, 483 bp, Homo sapiens
  misc_feature: HIJSMM301CVR4E.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggtaccgaaggtggagatcaaacgaactgtggctgcacca

SEQ ID NO: 593439 - DNA, 524 bp, Homo sapiens
  misc_feature: HIJSMM301EVJKY.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcacctctcgttcccgccctt

SEQ ID NO: 593440 - DNA, 484 bp, Homo sapiens; identical to SEQ ID NO: 535400
  misc_feature: HIJSMM301B9QUA.46.26.C04.1.454.light.4.raw

SEQ ID NO: 593441 - DNA, 503 bp, Homo sapiens; identical to SEQ ID NO: 561142
  misc_feature: HIJSMM301BAD4S.9.12.B01.1.454.light.4.raw

SEQ ID NO: 593442 - DNA, 489 bp, Homo sapiens; identical to SEQ ID NO: 537328
  misc_feature: HIJSMM301CXBLD.13.5.A05.1.454.light.4.raw

SEQ ID NO: 593443 - DNA, 487 bp, Homo sapiens
  misc_feature: HIJSMM301EFLRD.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcacatctgtt

SEQ ID NO: 593444 - DNA, 501 bp, Homo sapiens; identical to SEQ ID NO: 536818
  misc_feature: HIJSMM301CZKUE.12.82.H05.1.454.light.4.raw

SEQ ID NO: 593445 - DNA, 466 bp, Homo sapiens
  misc_feature: HIJSMM301A06L3.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataac

SEQ ID NO: 593446 - DNA, 490 bp, Homo sapiens
  misc_feature: HIJSMM301BU8LJ.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaaggtggagatacaaacgaaactgt

SEQ ID NO: 593447 - DNA, 508 bp, Homo sapiens; identical to SEQ ID NO: 581475
  misc_feature: HIJSMM301CKY1P.21.87.H10.1.454.light.4.raw

SEQ ID NO: 593448 - DNA, 522 bp, Homo sapiens
  misc_feature: HIJSMM301AW9ZD.52.35.D02.1.454.light.4.raw
cgcagtacgacacgaccggtgctcgatttagcacacgatagttgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccgaagggaccgaaggtggaaagtacaaacgaaactgtggctgcaccactctgtcttcatcttccccg

SEQ ID NO: 593449 - DNA, 512 bp, Homo sapiens; identical to SEQ ID NO: 556539
  misc_feature: HIJSMM301CRDPF.5.58.F03.1.454.light.4.raw

SEQ ID NO: 593450 - DNA, 502 bp, Homo sapiens; identical to SEQ ID NO: 543172
  misc_feature: HIJSMM301CHR91.18.59.F04.1.454.light.4.raw

SEQ ID NO: 593451 - DNA, 517 bp, Homo sapiens
  misc_feature: HIJSMM301CRDIA.13.55.E11.1.454.light.4.raw
tcacgtactacacgaccggtgctcgatttagcactcgcacgttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcaggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccccg

SEQ ID NO: 593452 - DNA, 499 bp, Homo sapiens
  misc_feature: HIJSMM301AI2ZC.40.73.G07.1.454.light.4.raw
tctagcgactcacgaccggtgctcgatttagctctacgctcagggggagagctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtatttttgtcaacaacatgataagtcaccgttcagctttggccgggggacccaggtggagatcagacgaactgtggctgcaccatctgtcttcatcttccccg

SEQ ID NO: 593453 - DNA, 496 bp, Homo sapiens; identical to SEQ ID NO: 567909
  misc_feature: HIJSMM301CO4YM.51.81.H04.1.454.light.4.raw

SEQ ID NO: 593454 - DNA, 494 bp, Homo sapiens
  misc_feature: HIJSMM301EJNYH.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaacctggagatcagtacgaa

SEQ ID NO: 593455 - DNA, 486 bp, Homo sapiens; identical to SEQ ID NO: 535458
  misc_feature: HIJSMM301BFC5C.7.75.G09.1.454.light.4.raw

SEQ ID NO: 593456 - DNA, 504 bp, Homo sapiens
  misc_feature: HIJSMM301DBR13.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggaggggaccaaggtgaccgtcctaggtcagtccaaggctgccccctcggt

SEQ ID NO: 593457 - DNA, 486 bp, Homo sapiens
  misc_feature: HIJSMM301BXPY2.49.41.D08.1.454.light.4.raw
agtcgagagacacgaccggtgctcgatttagtcacgcgagaaagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacgaa

SEQ ID NO: 593458 - DNA, 485 bp, Homo sapiens; identical to SEQ ID NO: 536695
  misc_feature: HIJSMM301EYFLR.10.1.A01.1.454.light.4.raw

SEQ ID NO: 593459 - DNA, 489 bp, Homo sapiens
  misc_feature: HIJSMM301ELAMA.17.25.C03.1.454.light.4.raw
cgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 593460 - DNA, 500 bp, Homo sapiens
  misc_feature: HIJSMM301CYYJJ.7.71.G05.1.454.light.4.raw
  modified_base (206)..(206): a, c, t, g, unknown or other
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgttcaacatcgtaccgagtggcctccggggccactttcggcctggaccaaagtggatatcaacgaactgtgctgcaccatctgtt

SEQ ID NO: 593461 - DNA, 490 bp, Homo sapiens; identical to SEQ ID NO: 535234
  misc_feature: HIJSMM301B4481.17.21.B10.1.454.light.4.raw

SEQ ID NO: 593462 - DNA, 310 bp, Homo sapiens; identical to SEQ ID NO: 574692
  misc_feature: HIJSMM301AXEND.43.19.B08.1.454.light.4.raw

SEQ ID NO: 593463 - DNA, 508 bp, Homo sapiens
  misc_feature: HIJSMM301CUNEK.17.2.A02.1.454.light.4.raw
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcgaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtctacgtcagcccaaggccaacccatgtcactctcgttcccgccct

SEQ ID NO: 593464 - DNA, 481 bp, Homo sapiens
  misc_feature: HIJSMM301AGB3J.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagttttattactgtcagcagtattgtgaagctccgctcactttcggcgggagggaccggcggtggagatcagacgaactgtggctgcaccatctgtctt

SEQ ID NO: 593465 - DNA, 486 bp, Homo sapiens; identical to SEQ ID NO: 546042
  misc_feature: HIJSMM301B4Z2E.14.53.E09.1.454.light.4.raw

SEQ ID NO: 593466 - DNA, 494 bp, Homo sapiens; identical to SEQ ID NO: 534994
  misc_feature: HIJSMM301B1471.27.78.H01.1.454.light.4.raw

SEQ ID NO: 593467 - DNA, 491 bp, Homo sapiens
  misc_feature: HIJSMM301EFDA4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggacccaaggcggaggatcagacgaactgtggctgcaccatctgtcttcta

SEQ ID NO: 593468 - DNA, 496 bp, Homo sapiens
  misc_feature: HIJSMM301CEWE4.22.86.H09.1.454.light.4.raw
  modified_base (488)..(488): a, c, t, g, unknown or other
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgccctccncaccgtcg

SEQ ID NO: 593469 - DNA, 495 bp, Homo sapiens
  misc_feature: HIJSMM301A1EW2.21.27.C05.1.454.light.4.raw
tcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtcttcta

SEQ ID NO: 593470 - DNA, 492 bp, Homo sapiens; identical to SEQ ID NO: 540428
  misc_feature: HIJSMM301DQFIS.51.81.H04.1.454.light.4.raw

SEQ ID NO: 593471 - DNA, 488 bp, Homo sapiens; identical to SEQ ID NO: 539884
  misc_feature: HIJSMM301AGUYI.7.85.H08.1.454.light.4.raw

SEQ ID NO: 593472 - DNA, 485 bp, Homo sapiens; identical to SEQ ID NO: 536527
  misc_feature: HIJSMM301CZN54.3.77.G11.1.454.light.4.raw

SEQ ID NO: 593473 - DNA, 493 bp, Homo sapiens
  misc_feature: HIJSMM301DTBTL.49.78.H01.1.454.light.4.raw
agtcgagagacacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggcccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatacaaacgaactggtgctgcaccatct

SEQ ID NO: 593474 - DNA, 519 bp, Homo sapiens; identical to SEQ ID NO: 544155
  misc_feature: HIJSMM301DHU6I.19.80.H03.1.454.light.4.raw

SEQ ID NO: 593475 - DNA, 515 bp, Homo sapiens
  misc_feature: HIJSMM301AXWPV.48.77.G11.1.454.light.4.raw
agtatacatacacgaccggtgctcgatttagctagtcactcaagggaaaggggtggtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccta

SEQ ID NO: 593476 - DNA, 514 bp, Homo sapiens
  misc_feature: HIJSMM301C61C5.51.53.E09.1.454.light.4.raw
cgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatagatctttgaggtcagtgatcggcccgcaggggtttctcatcgcttctccggctccaagtctggcagcacggcctccctgaccatctctgggctccaggctgaggacgaggctgattattactgcagctcatatacaaacagaaaacacttgggtgttcggcggcgggaccaaactgaccgtcctacgtcagcccaaggctgccccctcggtcactctgtt

SEQ ID NO: 593477 - DNA, 463 bp, Homo sapiens; identical to SEQ ID NO: 535062
  misc_feature: HIJSMM301AWXCY.11.73.G07.1.454.light.4.raw

SEQ ID NO: 593478 - DNA, 506 bp, Homo sapiens; identical to SEQ ID NO: 582293
  misc_feature: HIJSMM301B791J.18.37.D04.1.454.light.4.raw

SEQ ID NO: 593479 - DNA, 523 bp, Homo sapiens
  misc_feature: HIJSMM301CHJ8Y.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttctttggtttttggttggtcgggacccgacgatgactgtcctctagtacagcccgaacggcgtcgcccccgtcccggtccg

SEQ ID NO: 593480 - DNA, 522 bp, Homo sapiens; identical to SEQ ID NO: 544405
  misc_feature: HIJSMM301BF0IX.27.23.C01.1.454.light.4.raw

SEQ ID NO: 593481 - DNA, 517 bp, Homo sapiens; identical to SEQ ID NO: 548112
  misc_feature: HIJSMM301CQERI.3.87.H10.1.454.light.4.raw

SEQ ID NO: 593482 - DNA, 482 bp, Homo sapiens
  misc_feature: HIJSMM301D1ID9.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttatactgccaacactatgatagttacccgctcactttcggcggagggaccaaggtggaggtcaagcgaactgtggctgcacca

SEQ ID NO: 593483 - DNA, 500 bp, Homo sapiens
  misc_feature: HIJSMM301BEMSV.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggattgttggggtttattactgcatgcaagctctacaaactcgaacgttcggccaagggaccaaggtggaaatcaaacgaactgtggctgcaccatctgt

SEQ ID NO: 593484 - DNA, 509 bp, Homo sapiens
  misc_feature: HIJSMM301B2JPG.12.67.G01.1.454.light.4.raw
  modified_base (440)..(440): a, c, t, g, unknown or other
  modified_base (448)..(448): a, c, t, g, unknown or other
atacgacgtacacgaccggtgctcgatttagagtatacatattgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccagggcagacgcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcngcaccctntttgtcgttcggaagtgggaccaaggtcaccgtcctacgtcacgcccaacggccaaccccc

SEQ ID NO: 593485 - DNA, 496 bp, Homo sapiens
  misc_feature: HIJSMM301AKY1T.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtggctgcta

SEQ ID NO: 593486 - DNA, 465 bp, Homo sapiens
  misc_feature: HIJSMM301BKBE7.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaa

SEQ ID NO: 593487 - DNA, 491 bp, Homo sapiens
  misc_feature: HIJSMM301AFRM1.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggtccctggtaccgaactagtggagtaatcaaacgaaactagtggctgcaccaatctgtt

SEQ ID NO: 593488 - DNA, 486 bp, Homo sapiens; identical to SEQ ID NO: 537428
  misc_feature: HIJSMM301EYCFI.47.62.F07.1.454.light.4.raw

SEQ ID NO: 593489 - DNA, 514 bp, Homo sapiens
  misc_feature: HIJSMM301DPHFF.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccacccttcctcgagtagtaca

SEQ ID NO: 593490 - DNA, 484 bp, Homo sapiens; identical to SEQ ID NO: 536162
  misc_feature: HIJSMM301EPT50.13.59.F04.1.454.light.4.raw

SEQ ID NO: 593491 - DNA, 497 bp, Homo sapiens; identical to SEQ ID NO: 546781
  misc_feature: HIJSMM301DKCZV.43.28.C06.1.454.light.4.raw

SEQ ID NO: 593492 - DNA, 500 bp, Homo sapiens; identical to SEQ ID NO: 538756
  misc_feature: HIJSMM301ERXHF.12.86.H09.1.454.light.4.raw

SEQ ID NO: 593493 - DNA, 485 bp, Homo sapiens; identical to SEQ ID NO: 542261
  misc_feature: HIJSMM301B56LL.26.78.H01.1.454.light.4.raw

SEQ ID NO: 593494 - DNA, 486 bp, Homo sapiens; identical to SEQ ID NO: 535523
  misc_feature: HIJSMM301BCBQ1.22.73.G07.1.454.light.4.raw

SEQ ID NO: 593495 - DNA, 501 bp, Homo sapiens; identical to SEQ ID NO: 536142
  misc_feature: HIJSMM301CW8NF.15.1.A01.1.454.light.4.raw

SEQ ID NO: 593496 - DNA, 495 bp, Homo sapiens
  misc_feature: HIJSMM301CDGW3.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcatt

SEQ ID NO: 593497 - DNA, 488 bp, Homo sapiens; identical to SEQ ID NO: 536710
  misc_feature: HIJSMM301DCD4P.21.55.E11.1.454.light.4.raw

SEQ ID NO: 593498 - DNA, 507 bp, Homo sapiens
  misc_feature: HIJSMM301DATG2.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttacctcaagtgatcaccttcggaccaagggacacgactaggagaattaaacg

SEQ ID NO: 593499 - DNA, 447 bp, Homo sapiens; identical to SEQ ID NO: 549542
  misc_feature: HIJSMM301CSY0V.18.9.A09.1.454.light.4.raw

SEQ ID NO: 593500 - DNA, 496 bp, Homo sapiens; identical to SEQ ID NO: 535109
  misc_feature: HIJSMM301ATDCY.16.78.H01.1.454.light.4.raw

SEQ ID NO: 593501 - DNA, 500 bp, Homo sapiens; identical to SEQ ID NO: 541872
  misc_feature: HIJSMM301ANX7A.48.82.H05.1.454.light.4.raw

SEQ ID NO: 593502 - DNA, 484 bp, Homo sapiens; identical to SEQ ID NO: 535240
  misc_feature: HIJSMM301AWADX.47.60.F05.1.454.light.4.raw

SEQ ID NO: 593503 - DNA, 474 bp, Homo sapiens
  misc_feature: HIJSMM301D34XS.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccgaaggtggaaatcaaacgaactgtggc

SEQ ID NO: 593504 - DNA, 488 bp, Homo sapiens
  misc_feature: HIJSMM301B1DBI.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccagggaccaagctggagatcaaacgaactgtggctgcacca

SEQ ID NO: 593505 - DNA, 494 bp, Homo sapiens; identical to SEQ ID NO: 535828
  misc_feature: HIJSMM301EZQAX.3.36.D03.1.454.light.4.raw

SEQ ID NO: 593506 - DNA, 506 bp, Homo sapiens
  misc_feature: HIJSMM301EVUFY.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagttattactgtcaacatcgtaccgagtggcctccggggccactttcggccctgggaccaaattagagatcaacgaactgtggctgcaccatctgtcttcatcttcccg

SEQ ID NO: 593507 - DNA, 484 bp, Homo sapiens; identical to SEQ ID NO: 535400
  misc_feature: HIJSMM301CBRSY.46.26.C04.1.454.light.4.raw

SEQ ID NO: 593508 - DNA, 489 bp, Homo sapiens; identical to SEQ ID NO: 535386
  misc_feature: HIJSMM301BJN4J.12.51.E07.1.454.light.4.raw

SEQ ID NO: 593509 - DNA, 503 bp, Homo sapiens; identical to SEQ ID NO: 536834
  misc_feature: HIJSMM301EP0YO.2.35.D02.1.454.light.4.raw

SEQ ID NO: 593510 - DNA, 442 bp, Homo sapiens
  misc_feature: HIJSMM301AQTK1.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagccaaggctgcccctcggtcactctcgttcccaccctcctcgtactagacg

SEQ ID NO: 593511 - DNA, 491 bp, Homo sapiens
  misc_feature: HIJSMM301A3X3H.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaaggctggagatcaatcgaactgt

SEQ ID NO: 593512 - DNA, 384 bp, Homo sapiens
  misc_feature: HIJSMM301CH6KR.49.34.D01.1.454.light.4.raw
agtcgagagacacgaccggtgctcgatttagatcgtctgtgttgggtttgggtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgtcttcatcttcccgccatctgatctctcgact

SEQ ID NO: 593513 - DNA, 495 bp, Homo sapiens
  misc_feature: HIJSMM301B1MZI.19.71.G05.1.454.light.4.raw
tactctcgtgcacgaccggtgctcgatttagtgtcgtcgcaagagagagggggggtacaacaggcaggcagggtcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 593514 - DNA, 493 bp, Homo sapiens
  misc_feature: HIJSMM301EJ07K.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaagggtggagatcaaacgaactgtggctgcaccatctgt

SEQ ID NO: 593515 - DNA, 473 bp, Homo sapiens
  misc_feature: HIJSMM301CFUDK.51.16.B05.1.454.light.4.raw
cgatcgtatacacgaccggtgctcgatttagagctcacgtaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctcttgccaggcgagtcaggacattataagatatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaggatcttgcaacatattactgtcaacagtatgataatgtcccgtacacttttggccagggaccaagctggagatcagacgaactgtggctgcta

SEQ ID NO: 593516 - DNA, 515 bp, Homo sapiens; identical to SEQ ID NO: 547905
  misc_feature: HIJSMM301A71T7.8.23.C01.1.454.light.4.raw

SEQ ID NO: 593517 - DNA, 484 bp, Homo sapiens
  misc_feature: HIJSMM301BC3L1.40.25.C03.1.454.light.4.raw
tctagcgactcacgaccggtgctcgatttagtagtgtagatttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaa

SEQ ID NO: 593518 - DNA, 504 bp, Homo sapiens
  misc_feature: HIJSMM301EU4TI.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctccggt

SEQ ID NO: 593519 - DNA, 503 bp, Homo sapiens; identical to SEQ ID NO: 565401
  misc_feature: HIJSMM301DHIT9.17.27.C05.1.454.light.4.raw

SEQ ID NO: 593520 - DNA, 517 bp, Homo sapiens
  misc_feature: HIJSMM301DB42P.48.17.B06.1.454.light.4.raw
  modified_base (513)..(513): a, c, t, g, unknown or other
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccnccct

SEQ ID NO: 593521 - DNA, 522 bp, Homo sapiens
  misc_feature: HIJSMM301BBG5U.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccaccctcctccgtcg

SEQ ID NO: 593522 - DNA, 479 bp, Homo sapiens
  misc_feature: HIJSMM301B7U3A.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtgttttggctgttcggcgcgggacc

SEQ ID NO: 593523 - DNA, 484 bp, Homo sapiens
  misc_feature: HIJSMM301CZ039.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtgctgcaccatctgt

SEQ ID NO: 593524 - DNA, 497 bp, Homo sapiens; identical to SEQ ID NO: 535764
  misc_feature: HIJSMM301CSGEI.22.20.B09.1.454.light.4.raw

SEQ ID NO: 593525 - DNA, 506 bp, Homo sapiens
  misc_feature: HIJSMM301EA6A2.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgcgtccgggtctcctggacagtcagtcaccatctcctgcactggaaccagcagtaacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggt

SEQ ID NO: 593526 - DNA, 499 bp, Homo sapiens; identical to SEQ ID NO: 547044
  misc_feature: HIJSMM301CPV2X.43.71.G05.1.454.light.4.raw

SEQ ID NO: 593527 - DNA, 474 bp, Homo sapiens; identical to SEQ ID NO: 538184
  misc_feature: HIJSMM301EBUS5.13.76.G10.1.454.light.4.raw

SEQ ID NO: 593528 - DNA, 522 bp, Homo sapiens; identical to SEQ ID NO: 563052
  misc_feature: HIJSMM301AK0SC.27.23.C01.1.454.light.4.raw

SEQ ID NO: 593529 - DNA, 487 bp, Homo sapiens; identical to SEQ ID NO: 535583
  misc_feature: HIJSMM301AWSR9.22.73.G07.1.454.light.4.raw

SEQ ID NO: 593530 - DNA, 494 bp, Homo sapiens
  misc_feature: HIJSMM301CGFF4.41.2.A02.1.454.light.4.raw
tctatactatcacgaccggtgctcgatttagactcatctacagggggtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaaggttgagatcaaacgaactgtggctgcaccatctgtcttcatcttccccg

SEQ ID NO: 593531 - DNA, 475 bp, Homo sapiens
  misc_feature: HIJSMM301EO233.49.35.D02.1.454.light.4.raw
agtcgagagacacgaccggtgctcgatttagcacacgatagttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctgca

SEQ ID NO: 593532 - DNA, 509 bp, Homo sapiens; identical to SEQ ID NO: 547302
  misc_feature: HIJSMM301B33Z5.4.57.F02.1.454.light.4.raw

SEQ ID NO: 593533 - DNA, 509 bp, Homo sapiens
  misc_feature: HIJSMM301CX1HC.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccacgttcggccctgggaccaaacgtggatatcaaacgaactgtggctgcaccatctgtcttcta

SEQ ID NO: 593534 - DNA, 457 bp, Homo sapiens
  misc_feature: HIJSMM301DP03I.48.30.C08.1.454.light.4.raw
agtatacatacacgaccggtgctcgatttagtctgacgtcaaagggaaagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttacaccgcaaagcggggacccagaccctggagcctcagttggaagcagccgatccagcctgcggagcctgtggggcaggtcagcccaaggccaaccccactgtcactctgttcccgccctcctctatgtatact

SEQ ID NO: 593535 - DNA, 486 bp, Homo sapiens; identical to SEQ ID NO: 586790
  misc_feature: HIJSMM301BS36B.47.46.E02.1.454.light.4.raw

SEQ ID NO: 593536 - DNA, 503 bp, Homo sapiens; identical to SEQ ID NO: 574363
  misc_feature: HIJSMM301DO307.2.35.D02.1.454.light.4.raw

SEQ ID NO: 593537 - DNA, 489 bp, Homo sapiens; identical to SEQ ID NO: 535139
  misc_feature: HIJSMM301AFKOH.14.55.E11.1.454.light.4.raw

SEQ ID NO: 593538 - DNA, 473 bp, Homo sapiens; identical to SEQ ID NO: 535262
  misc_feature: HIJSMM301ADUJU.8.67.G01.1.454.light.4.raw

SEQ ID NO: 593539 - DNA, 493 bp, Homo sapiens
  misc_feature: HIJSMM301EBVOX.41.21.B10.1.454.light.4.raw
tctatactatcacgaccggtgctcgatttagtgtcgtcgcaagggggagccctggggaggaactgctcagttaggacccagagggaaccatggaagccccagctcagcttctcttcctcctgctactctggctcccagataccaccggacaaattgtgttgacacagtctccagccaccctgtctttgtctccaggggaaagagccaccctctcctgcagggccagtcagagtgttagcaaccacttagcctggtaccaacagagacctggccagactcccagactcgtcatctatgatgcatccaagagggccactggcatcccagccaggttcagtggcagtgggtctgggacagacttcactctcaccatcagcagcctagagcctgaagattttgctagtttattactgtcagcagcgtggcgactggcctcgcatcaccttcggccaagggacacgactggagactagacgaactgtggctgcaccta

SEQ ID NO: 593540 - DNA, 484 bp, Homo sapiens; identical to SEQ ID NO: 540581
  misc_feature: HIJSMM301BI5KO.3.88.H11.1.454.light.4.raw

SEQ ID NO: 593541 - DNA, 503 bp, Homo sapiens
  misc_feature: HIJSMM301CLYZV.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtggggtcttcggcggagggaccaagctgaccgtcctaagtcagcccaaggctgccccctcggtcta

SEQ ID NO: 593542 - DNA, 506 bp, Homo sapiens
  misc_feature: HIJSMM301A658P.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatacaaacgaactgtggctgcaccatctgtcttcatcttcccgcca

SEQ ID NO: 593543 - DNA, 490 bp, Homo sapiens
  misc_feature: HIJSMM301DUPOY.4.43.D10.1.454.light.4.raw
agcactgtagcacgaccggtgctcgatttagactagcagtaaggggggagtcagtctcagtcaggacacagcatggacatgagggtccccgctcagctcctggggctcctgctactctggctccgaggtggcagatgtgacatccagatgacccagtctccatcctccctgtctgcatctgtaggggacagcgtcaccatcacttgccggacaagtcagagcattaaccggtatttaaattggtatcagcaaaaaccaggggaagcccctaaactcctgatctatgctgcatccactttgcacagtggggtcccatcgaggttcagtggcagtggagctgggacagatttcactctcaccatcagcagtctgcaacctgaagattttgcaacttacttctgtcaacagagttacagttcccggacgttcggccaacgggaccgaaagtaggaatacatacgaactagtggctgcaccatctgtcttctat

SEQ ID NO: 593544 - DNA, 486 bp, Homo sapiens; identical to SEQ ID NO: 535290
  misc_feature: HIJSMM301BQDIT.3.12.B01.1.454.light.4.raw

SEQ ID NO: 593545 - DNA, 444 bp, Homo sapiens; identical to SEQ ID NO: 535042
  misc_feature: HIJSMM301A2WJZ.10.76.G10.1.454.light.4.raw

SEQ ID NO: 593546 - DNA, 488 bp, Homo sapiens
  misc_feature: HIJSMM301BAQOW.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtcggagatacaaacgaact

SEQ ID NO: 593547 - DNA, 505 bp, Homo sapiens
  misc_feature: HIJSMM301AJDOM.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggccccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaagtggatatcaaacgaactagtggctgcaccatctgtctt

SEQ ID NO: 593548 - DNA, 494 bp, Homo sapiens; identical to SEQ ID NO: 534992
  misc_feature: HIJSMM301B1DGU.9.1.A01.1.454.light.4.raw

SEQ ID NO: 593549 - DNA, 499 bp, Homo sapiens; identical to SEQ ID NO: 537739
  misc_feature: HIJSMM301CTDI5.12.86.H09.1.454.light.4.raw

SEQ ID NO: 593550 - DNA, 480 bp, Homo sapiens; identical to SEQ ID NO: 555806
  misc_feature: HIJSMM301CWG7F.7.76.G10.1.454.light.4.raw

SEQ ID NO: 593551 - DNA, 520 bp, Homo sapiens
  misc_feature: HIJSMM301AN3B7.52.28.C06.1.454.light.4.raw
  modified_base (513)..(513): a, c, t, g, unknown or other
cgcagtacgacacgaccggtgctcgatttagagctcacgtattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtggaaagtacaaacgaaactgtggctgcaccatctgtcttcactnttccccg

SEQ ID NO: 593552 - DNA, 447 bp, Homo sapiens; identical to SEQ ID NO: 535201
  misc_feature: HIJSMM301BXQYC.18.9.A09.1.454.light.4.raw

SEQ ID NO: 593553 - DNA, 512 bp, Homo sapiens
  misc_feature: HIJSMM301ETIUH.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccc

SEQ ID NO: 593554 - DNA, 493 bp, Homo sapiens; identical to SEQ ID NO: 535566
  misc_feature: HIJSMM301EWU4C.16.6.A06.1.454.light.4.raw

SEQ ID NO: 593555 - DNA, 494 bp, Homo sapiens; identical to SEQ ID NO: 554249
  misc_feature: HIJSMM301BYCHD.10.33.C11.1.454.light.4.raw

SEQ ID NO: 593556 - DNA, 448 bp, Homo sapiens
  misc_feature: HIJSMM301CAFXU.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagtctgagtggttcgtatgtcttcggatctgggaccaaggtcaccgtcctaagtcagcccaaggccaacccctctgtcactctcgttcccaccctcctccatactcgta

SEQ ID NO: 593557 - DNA, 512 bp, Homo sapiens; identical to SEQ ID NO: 572033
  misc_feature: HIJSMM301A7C75.15.59.F04.1.454.light.4.raw

SEQ ID NO: 593558 - DNA, 514 bp, Homo sapiens; identical to SEQ ID NO: 546238
  misc_feature: HIJSMM301CIHY3.47.85.H08.1.454.light.4.raw

SEQ ID NO: 593559 - DNA, 361 bp, Homo sapiens; identical to SEQ ID NO: 540413
  misc_feature: HIJSMM301BSEHL.3.57.F02.1.454.light.4.raw

SEQ ID NO: 593560 - DNA, 495 bp, Homo sapiens; identical to SEQ ID NO: 537273
  misc_feature: HIJSMM301DXQQY.15.26.C04.1.454.light.4.raw

SEQ ID NO: 593561 - DNA, 492 bp, Homo sapiens; identical to SEQ ID NO: 537395
  misc_feature: HIJSMM301AOWRR.16.73.G07.1.454.light.4.raw

SEQ ID NO: 593562 - DNA, 506 bp, Homo sapiens
  misc_feature: HIJSMM301CN3GT.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaagggaccaaggtaggaaagtacaaaacgaaacgtagtggctggcacca

SEQ ID NO: 593563 - DNA, 486 bp, Homo sapiens; identical to SEQ ID NO: 535043
  misc_feature: HIJSMM301CDXCS.46.35.D02.1.454.light.4.raw

SEQ ID NO: 593564 - DNA, 487 bp, Homo sapiens; identical to SEQ ID NO: 559542
  misc_feature: HIJSMM301DV4ID.26.23.C01.1.454.light.4.raw

SEQ ID NO: 593565 - DNA, 484 bp, Homo sapiens; identical to SEQ ID NO: 538396
  misc_feature: HIJSMM301BLH0E.15.1.A01.1.454.light.4.raw

SEQ ID NO: 593566 - DNA, 506 bp, Homo sapiens; identical to SEQ ID NO: 534969
  misc_feature: HIJSMM301ASTDT.18.37.D04.1.454.light.4.raw

SEQ ID NO: 593567 - DNA, 495 bp, Homo sapiens; identical to SEQ ID NO: 542571
  misc_feature: HIJSMM301D4PU6.7.59.F04.1.454.light.4.raw

SEQ ID NO: 593568 - DNA, 508 bp, Homo sapiens
  misc_feature: HIJSMM301BB41T.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaagggtggagatacaaacgaactgtggctgcaccatctgtt

SEQ ID NO: 593569 - DNA, 514 bp, Homo sapiens
  misc_feature: HIJSMM301DUKY9.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccgggacagaagtggtaattacatggtgttcggcggagggaccaagctgaccgtcctacgtcacgcccaaggctcgccccctcggtcaccgtcttccg

SEQ ID NO: 593570 - DNA, 492 bp, Homo sapiens; identical to SEQ ID NO: 541747
  misc_feature: HIJSMM301EUF4E.19.71.G05.1.454.light.4.raw

SEQ ID NO: 593571 - DNA, 488 bp, Homo sapiens; identical to SEQ ID NO: 539884
  misc_feature: HIJSMM301EUW04.7.85.H08.1.454.light.4.raw

SEQ ID NO: 593572 - DNA, 484 bp, Homo sapiens
  misc_feature: HIJSMM301DW38S.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatattttaccctcgtattttcggcccttgggaccacagtagatatacaaacgaactgtggctgcaccat

SEQ ID NO: 593573 - DNA, 483 bp, Homo sapiens; identical to SEQ ID NO: 547837
  misc_feature: HIJSMM301DEE6I.48.40.D07.1.454.light.4.raw

SEQ ID NO: 593574 - DNA, 498 bp, Homo sapiens; identical to SEQ ID NO: 535295
  misc_feature: HIJSMM301EXGHR.15.25.C03.1.454.light.4.raw

SEQ ID NO: 593575 - DNA, 481 bp, Homo sapiens; identical to SEQ ID NO: 537385
  misc_feature: HIJSMM301ERADU.52.4.A04.1.454.light.4.raw

SEQ ID NO: 593576 - DNA, 493 bp, Homo sapiens; identical to SEQ ID NO: 536289
  misc_feature: HIJSMM301CDWZB.14.5.A05.1.454.light.4.raw

SEQ ID NO: 593577 - DNA, 494 bp, Homo sapiens; identical to SEQ ID NO: 535276
  misc_feature: HIJSMM301DD0D0.16.6.A06.1.454.light.4.raw

SEQ ID NO: 593578 - DNA, 522 bp, Homo sapiens; identical to SEQ ID NO: 541090
  misc_feature: HIJSMM301DBD7U.27.23.C01.1.454.light.4.raw

SEQ ID NO: 593579 - DNA, 513 bp, Homo sapiens; identical to SEQ ID NO: 559106
  misc_feature: HIJSMM301C4TH1.11.57.F02.1.454.light.4.raw

SEQ ID NO: 593580 - DNA, 442 bp, Homo sapiens
  misc_feature: HIJSMM301DFBTK.11.3.A03.1.454.light.4.raw
  modified_base (297)..(297): a, c, t, g, unknown or other
  modified_base (424)..(424): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccancctgaggatgaggctgattattactgtcagtcctttgacattaaaactggatgtggtattcggcggagggaccccagtaaccgtcctaggtcagcccaaggctgccccctcggtcactctgttcccnccctcctcgtatctctcg

SEQ ID NO: 593581 - DNA, 510 bp, Homo sapiens
  misc_feature: HIJSMM301CSUD8.17.23.C01.1.454.light.4.raw
cgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcgggggaaggaacattggaagtaaaagtgtgcagtggtaccagcagaagccaggccaggcccctattctggtcgtctatgatgatagcgaccggccctcagggatccctgagcgattctctggctccaactctgacaacacggccaccctgaccatcagtagggtcggagccggggatgagggcgactattactgtcaggtgtgggatcacactagtgatcattatgtcttcggatcggggaccgaggtcaccgtcctaggtcagcccaaggccaaccccactgtcactctgttccca

SEQ ID NO: 593582 - DNA, 513 bp, Homo sapiens
  misc_feature: HIJSMM301A6UXT.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgtccaccctcctcg

SEQ ID NO: 593583 - DNA, 514 bp, Homo sapiens
  misc_feature: HIJSMM301CX4WN.16.66.F11.1.454.light.4.raw
  modified_base (496)..(496): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccnccctcctcgagtagtaca

SEQ ID NO: 593584 - DNA, 447 bp, Homo sapiens; identical to SEQ ID NO: 535020
  misc_feature: HIJSMM301DHHNM.18.9.A09.1.454.light.4.raw

SEQ ID NO: 593585 - DNA, 499 bp, Homo sapiens
  misc_feature: HIJSMM301DKW3T.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaagggtgaccgtcctacgtcagcccaaggctcgccccctcggtcactctcg

SEQ ID NO: 593586 - DNA, 488 bp, Homo sapiens
  misc_feature: HIJSMM301BPBMZ.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggaggatcaaacgaa

SEQ ID NO: 593587 - DNA, 485 bp, Homo sapiens; identical to SEQ ID NO: 545289
  misc_feature: HIJSMM301C7WLA.19.71.G05.1.454.light.4.raw

SEQ ID NO: 593588 - DNA, 495 bp, Homo sapiens; identical to SEQ ID NO: 588904
  misc_feature: HIJSMM301ESIX4.11.81.H04.1.454.light.4.raw

SEQ ID NO: 593589 - DNA, 486 bp, Homo sapiens; identical to SEQ ID NO: 535290
  misc_feature: HIJSMM301DJS6X.3.12.B01.1.454.light.4.raw

SEQ ID NO: 593590 - DNA, 496 bp, Homo sapiens; identical to SEQ ID NO: 537925
  misc_feature: HIJSMM301DFLWS.22.14.B03.1.454.light.4.raw

SEQ ID NO: 593591 - DNA, 483 bp, Homo sapiens
  misc_feature: HIJSMM301C9IC1.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagccctatggatgaggctgactattactgtcaggcgtgggacagtaggtttgtgcttttcggcggagggaccaagctgaccgtcctacgtcagcccaaggctgccccctcc

SEQ ID NO: 593592 - DNA, 494 bp, Homo sapiens; identical to SEQ ID NO: 535276
  misc_feature: HIJSMM301ADKPM.16.6.A06.1.454.light.4.raw

SEQ ID NO: 593593 - DNA, 497 bp, Homo sapiens; identical to SEQ ID NO: 536376
  misc_feature: HIJSMM301CIPZS.22.9.A09.1.454.light.4.raw

SEQ ID NO: 593594 - DNA, 513 bp, Homo sapiens
  misc_feature: HIJSMM301B05OJ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccacctcctcgctacgtagac

SEQ ID NO: 593595 - DNA, 494 bp, Homo sapiens; identical to SEQ ID NO: 536463
  misc_feature: HIJSMM301D6FAZ.22.57.F02.1.454.light.4.raw

SEQ ID NO: 593596 - DNA, 502 bp, Homo sapiens; identical to SEQ ID NO: 541971
  misc_feature: HIJSMM301DMG5O.4.39.D06.1.454.light.4.raw

SEQ ID NO: 593597 - DNA, 492 bp, Homo sapiens
  misc_feature: HIJSMM301CUD97.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaacgaactgtgctgcaccatctgtctt

SEQ ID NO: 593598 - DNA, 488 bp, Homo sapiens
  misc_feature: HIJSMM301CK816.49.63.F08.1.454.light.4.raw
  modified_base (417)..(417): a, c, t, g, unknown or other
agtcgagagacacgaccggtgctcgatttagcgatcgtataagggggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcaacttatttaaattggtatcaacataccccggggaaggcccctaggttactgatctatgctgcagccaatttgcaaagtggggtcccatcaaggttcagtggcagtggatctgggacagaattcactctcaccatcagcagtctgcaactgaagattttggaaagtactattgtcaacagagttacggaaacttgctcattttcggnggagggaccaaggtggagatcaaacgaactgtggctgcaccatctgtcttcatcttcccgccactctgatt

SEQ ID NO: 593599 - DNA, 486 bp, Homo sapiens
  misc_feature: HIJSMM301DHQWD.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaggatcaaagacg

SEQ ID NO: 593600 - DNA, 501 bp, Homo sapiens; identical to SEQ ID NO: 535746
  misc_feature: HIJSMM301E1T46.18.11.A11.1.454.light.4.raw

SEQ ID NO: 593601 - DNA, 493 bp, Homo sapiens; identical to SEQ ID NO: 535084
  misc_feature: HIJSMM301EOI7H.47.64.F09.1.454.light.4.raw

SEQ ID NO: 593602 - DNA, 520 bp, Homo sapiens; identical to SEQ ID NO: 537173
  misc_feature: HIJSMM301EVCI2.27.23.C01.1.454.light.4.raw

SEQ ID NO: 593603 - DNA, 498 bp, Homo sapiens; identical to SEQ ID NO: 536879
  misc_feature: HIJSMM301DP0BH.22.14.B03.1.454.light.4.raw

SEQ ID NO: 593604 - DNA, 485 bp, Homo sapiens
  misc_feature: HIJSMM301EBDQE.48.37.D04.1.454.light.4.raw
agtatacatacacgaccggtgctcgatttagtagcatactgttgggtttggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaaggaccaaggtcggaagtcaaacgaactagtggctgcacca

SEQ ID NO: 593605 - DNA, 485 bp, Homo sapiens; identical to SEQ ID NO: 536576
  misc_feature: HIJSMM301CQWKO.46.35.D02.1.454.light.4.raw

SEQ ID NO: 593606 - DNA, 500 bp, Homo sapiens
  misc_feature: HIJSMM301ECWNV.13.38.D05.1.454.light.4.raw
  modified_base (489)..(489): a, c, t, g, unknown or other
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcgagcgggacggaccgaaggtgcagatacaaacgaactggtggtctgccaacntctgtcttcta

SEQ ID NO: 593607 - DNA, 512 bp, Homo sapiens; identical to SEQ ID NO: 545961
  misc_feature: HIJSMM301BG5UT.14.78.H01.1.454.light.4.raw

SEQ ID NO: 593608 - DNA, 521 bp, Homo sapiens; identical to SEQ ID NO: 538715
  misc_feature: HIJSMM301BKPDD.27.23.C01.1.454.light.4.raw

SEQ ID NO: 593609 - DNA, 505 bp, Homo sapiens; identical to SEQ ID NO: 536117
  misc_feature: HIJSMM301DRL1J.8.71.G05.1.454.light.4.raw

SEQ ID NO: 593610 - DNA, 494 bp, Homo sapiens; identical to SEQ ID NO: 564757
  misc_feature: HIJSMM301CLX6X.51.81.H04.1.454.light.4.raw

SEQ ID NO: 593611 - DNA, 512 bp, Homo sapiens; identical to SEQ ID NO: 541402
  misc_feature: HIJSMM301EAU75.43.19.B08.1.454.light.4.raw

SEQ ID NO: 593612 - DNA, 510 bp, Homo sapiens; identical to SEQ ID NO: 542037
  misc_feature: HIJSMM301BM2UR.4.57.F02.1.454.light.4.raw

SEQ ID NO: 593613 - DNA, 494 bp, Homo sapiens
  misc_feature: HIJSMM301CMHPA.8.81.H04.1.454.light.4.raw
ctcgcgtgtccacgaccggtgctcgatttagtagtgtagattcgcgggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggtacacttttggccgggggaccaagctggagatcaaacgaactgtggctgcaccatctgtcttcta

SEQ ID NO: 593614 - DNA, 502 bp, Homo sapiens; identical to SEQ ID NO: 543913
  misc_feature: HIJSMM301BFWQO.18.26.C04.1.454.light.4.raw

SEQ ID NO: 593615 - DNA, 505 bp, Homo sapiens; identical to SEQ ID NO: 555429
  misc_feature: HIJSMM301BH76H.4.71.G05.1.454.light.4.raw

SEQ ID NO: 593616 - DNA, 485 bp, Homo sapiens; identical to SEQ ID NO: 536040
  misc_feature: HIJSMM301DUJKW.15.1.A01.1.454.light.4.raw

SEQ ID NO: 593617 - DNA, 447 bp, Homo sapiens; identical to SEQ ID NO: 535201
  misc_feature: HIJSMM301DGC4N.18.9.A09.1.454.light.4.raw

SEQ ID NO: 593618 - DNA, 498 bp, Homo sapiens; identical to SEQ ID NO: 578417
  misc_feature: HIJSMM301EOV8K.18.11.A11.1.454.light.4.raw

SEQ ID NO: 593619 - DNA, 493 bp, Homo sapiens
  misc_feature: HIJSMM301A3T2A.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggaggaccaaggtggagatcaaacgaact

SEQ ID NO: 593620 - DNA, 488 bp, Homo sapiens; identical to SEQ ID NO: 553834
  misc_feature: HIJSMM301BOTBZ.17.35.D02.1.454.light.4.raw

SEQ ID NO: 593621 - DNA, 490 bp, Homo sapiens; identical to SEQ ID NO: 558441
  misc_feature: HIJSMM301BLOFX.43.33.C11.1.454.light.4.raw

SEQ ID NO: 593622 - DNA, 499 bp, Homo sapiens; identical to SEQ ID NO: 537739
  misc_feature: HIJSMM301DS0T6.12.86.H09.1.454.light.4.raw

SEQ ID NO: 593623 - DNA, 514 bp, Homo sapiens; identical to SEQ ID NO: 541418
  misc_feature: HIJSMM301EK845.17.33.C11.1.454.light.4.raw

SEQ ID NO: 593624 - DNA, 482 bp, Homo sapiens; identical to SEQ ID NO: 535920
  misc_feature: HIJSMM301C6KGB.19.71.G05.1.454.light.4.raw

SEQ ID NO: 593625 - DNA, 495 bp, Homo sapiens
  misc_feature: HIJSMM301CG7T1.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccgaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacacgaactggagataaaggaatagtggctgcaccatctgtcttctatcttccccg

SEQ ID NO: 593626 - DNA, 491 bp, Homo sapiens
  misc_feature: HIJSMM301BMCRU.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaattcggcggagggaccaaggtggagatcaaacgaactgtggctgcaccatctgtcttcatcttcccgccta

SEQ ID NO: 593627 - DNA, 492 bp, Homo sapiens
  misc_feature: HIJSMM301C95OH.15.3.A03.1.454.light.4.raw
  modified_base (432)..(432): a, c, t, g, unknown or other
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtnttccttttactttcggccctgggaccaaagtggatatcaaacgaactgtggctgcaccat

SEQ ID NO: 593628 - DNA, 488 bp, Homo sapiens; identical to SEQ ID NO: 538612
  misc_feature: HIJSMM301EOQNX.4.59.F04.1.454.light.4.raw

SEQ ID NO: 593629 - DNA, 494 bp, Homo sapiens; identical to SEQ ID NO: 534994
  misc_feature: HIJSMM301D4TYB.27.78.H01.1.454.light.4.raw

SEQ ID NO: 593630 - DNA, 489 bp, Homo sapiens
  misc_feature: HIJSMM301AX13R.5.41.D08.1.454.light.4.raw
atcagacacgcacgaccggtgctcgatttagtcacgcgagaaagggaaagggggatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaaaccctattcactttcggccctcggaccgagagtggatatcaaacgaactagt

SEQ ID NO: 593631 - DNA, 508 bp, Homo sapiens
  misc_feature: HIJSMM301AVEVN.14.55.E11.1.454.light.4.raw
  modified_base (464)..(464): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttataactgtcaacagagttaacagtacccccctctaccttcgtcggacgggacgaacggacggaggaganagaacgaacgtaacgtggtcgtgcaccaactactcgtcttctta

SEQ ID NO: 593632 - DNA, 506 bp, Homo sapiens
  misc_feature: HIJSMM301EAHIA.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccaccctcctcctacgtcgtat

SEQ ID NO: 593633 - DNA, 514 bp, Homo sapiens
  misc_feature: HIJSMM301AGE9M.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccgactttcggcccgtcgggaccgaacgtaggagatcaaacgaactgtggctgcaccactctgtcttcta

SEQ ID NO: 593634 - DNA, 505 bp, Homo sapiens
  misc_feature: HIJSMM301DW4SO.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaatgaccgtcctaggtcagcccaaggctgccccctcggtcactctcgtt

SEQ ID NO: 593635 - DNA, 505 bp, Homo sapiens; identical to SEQ ID NO: 571264
  misc_feature: HIJSMM301B4ROL.19.78.H01.1.454.light.4.raw

SEQ ID NO: 593636 - DNA, 486 bp, Homo sapiens
  misc_feature: HIJSMM301CULDD.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcccccatcgctgggctccaggctgacgatgaggctgattattattgccagtcctatgacaacaccctgcgtggttttggtctgttcggcggcgggacc

SEQ ID NO: 593637 - DNA, 485 bp, Homo sapiens
  misc_feature: HIJSMM301C34ER.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttggccaggggaccaaaggtcgaaatagagacggaactgtggctgcaccat

SEQ ID NO: 593638 - DNA, 461 bp, Homo sapiens
  misc_feature: HIJSMM301CCGZS.11.86.H09.1.454.light.4.raw
cgagagataccacgaccggtgctcgatttagtgctatagacttgggtttggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggtttttcggcggagggaccaagctgaccgtcctaggtcagcccaaggctgcccctccggtcactctgttcccgccctcctccgtatctctcg

SEQ ID NO: 593639 - DNA, 515 bp, Homo sapiens
  misc_feature: HIJSMM301CNIZU.16.46.E02.1.454.light.4.raw
tgtactactccacgaccggtgctcgatttagactcatctacagggaaaggggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactgggaaccagcagtgacgttggtagttataaccgtgtctcctggtaccagcagcccccaggcaccagcccccaaactcatgatttatgaagtcagtaatcgggccctcaggggtccctgatcgcttctctgggtccaagtctggcaacacggcctcctgaccatctctgggctccaggctgaggacgtaggctgattattactgcagcttatatacaggcaacaatacttttgtcttcggaactgggaccaaggtcaccgtcctaggtcagcccaaggccaacccactgtcactctcg

SEQ ID NO: 593640 - DNA, 484 bp, Homo sapiens
  misc_feature: HIJSMM301D9PI5.3.40.D07.1.454.light.4.raw
agacgcactccacgaccggtgctcgatttagtgatagagcgtaacaacagagggggagtcagactcagtcaggacacagcatggacatgagggtccccgctcagctcctggggctcctgctgctctggctcccaggtgccagatgtgacatccagatgacccagtctccttccaccctgtctgcctctataggagacagagtcaccatcacttgcggggccagtcagagtataagtaatttgttggcctggtatcagcagaaaccaggcaaagccccaaagctccttatttctgatgcctccactttgcacgttggggtcccaccaacgttcagcggcagtggatctgggacagatttcactctcaccatcagcagcctgcagcctgatgatgttgcaacttattactgtcaacaatataacacttattggacgttcggccaggggaccaaggtggaaatcaaacgaactagtggctgcaccat

SEQ ID NO: 593641 - DNA, 493 bp, Homo sapiens; identical to SEQ ID NO: 551874
  misc_feature: HIJSMM301CU86K.18.11.A11.1.454.light.4.raw

SEQ ID NO: 593642 - DNA, 505 bp, Homo sapiens
  misc_feature: HIJSMM301CO78X.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctcctatcatgatgccaagcggccctcagggatccctgagcgattctctggctccaactctggggacacagccactctgaccatccgcgggacccaggctgtggatgaggctgactattactgtcaggcgtgggacagggaggctggcgtagttttcggcggagggaccagtctgaccgtcctaggtcagcccaaggctgccccctcggtccactcttcg

SEQ ID NO: 593643 - DNA, 512 bp, Homo sapiens; identical to SEQ ID NO: 562981
  misc_feature: HIJSMM301BZSCO.49.16.B05.1.454.light.4.raw

SEQ ID NO: 593644 - DNA, 494 bp, Homo sapiens; identical to SEQ ID NO: 534994
  misc_feature: HIJSMM301CPZ6F.27.78.H01.1.454.light.4.raw

SEQ ID NO: 593645 - DNA, 383 bp, Homo sapiens; identical to SEQ ID NO: 447524
  misc_feature: HIJSMM301CWETK.41.26.C04.1.454.light.4.raw

SEQ ID NO: 593646 - DNA, 483 bp, Homo sapiens
  misc_feature: HIJSMM301D4ZSM.49.51.E07.1.454.light.4.raw
agtcgagagacacgaccggtgctcgatttagcatactctacaacacacaaaggggagtcccagtcaggacacagcatggacatgagggtccccgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttacccgctcactttcggcgggagggaccgaaggtggagatcagacgaactgtggctgcaccat

SEQ ID NO: 593647 - DNA, 424 bp, Homo sapiens
  misc_feature: HIJSMM301EVDXF.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacacgcccccaaagtcatcatttatgacaacatgaagcggccctcgaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaacccactgtcactctgttcccaccctcctcagacgtatca

SEQ ID NO: 593648 - DNA, 504 bp, Homo sapiens
  misc_feature: HIJSMM301AYQQE.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctagggtcagcccaaggccaacccactgtca

SEQ ID NO: 593649 - DNA, 447 bp, Homo sapiens; identical to SEQ ID NO: 535020
  misc_feature: HIJSMM301DLF7T.18.9.A09.1.454.light.4.raw

SEQ ID NO: 593650 - DNA, 491 bp, Homo sapiens
  misc_feature: HIJSMM301ALDCA.5.11.A11.1.454.light.4.raw
atcagacacgcacgaccggtgctcgatttagctacgactgcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggaggatcaaacgaactgtggctgcacc

SEQ ID NO: 593651 - DNA, 481 bp, Homo sapiens
  misc_feature: HIJSMM301AE1OO.13.48.E04.1.454.light.4.raw
tcacgtactacacgaccggtgctcgatttagagagcgtcacagagagaagggggcaggagtcagacccactcaggacacagcatggacatgagggtccccgctcagctcctggggatcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatacaaacgaactagtgg

SEQ ID NO: 593652 - DNA, 517 bp, Homo sapiens
  misc_feature: HIJSMM301D1R75.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcacgttggaagcagccgatccagcctgcggagcctgtggggcaggtcagcccaaggctgccccctcggtcactctgtcccaccctcctccacg

SEQ ID NO: 593653 - DNA, 479 bp, Homo sapiens; identical to SEQ ID NO: 538892
  misc_feature: HIJSMM301DBLJS.22.59.F04.1.454.light.4.raw

SEQ ID NO: 593654 - DNA, 496 bp, Homo sapiens
  misc_feature: HIJSMM301ENC1L.49.52.E08.1.454.light.4.raw
agtcgagagacacgaccggtgctcgatttagtcgagctctcagagagaaagggcacgaccggtgctcgatttagtacagatcgttagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaaccg

SEQ ID NO: 593655 - DNA, 518 bp, Homo sapiens
  misc_feature: HIJSMM301CWRDI.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccacggaccgaacggtaggaagtacgaaacgaacgtacgtggcgtgcaccatctgttcttctactcttcccgtcccact

SEQ ID NO: 593656 - DNA, 502 bp, Homo sapiens; identical to SEQ ID NO: 559615
  misc_feature: HIJSMM301AZVNK.21.81.H04.1.454.light.4.raw

SEQ ID NO: 593657 - DNA, 466 bp, Homo sapiens
  misc_feature: HIJSMM301CEE1F.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaagtggggtcccatcgagattcagcggcagtggatctggcacagagttcactctcaccatcagcaccctgcagcctgaagattttgcgacttatttctgtctacaagattctaattaccctcggacgttcggccagggaccaaagtggatgtcaaccgaa

SEQ ID NO: 593658 - DNA, 486 bp, Homo sapiens; identical to SEQ ID NO: 536165
  misc_feature: HIJSMM301EB3Z2.5.71.G05.1.454.light.4.raw

SEQ ID NO: 593659 - DNA, 490 bp, Homo sapiens
  misc_feature: HIJSMM301B4TS9.46.35.D02.1.454.light.4.raw
actagcagtacacgaccggtgctcgatttagcacacgatagttgggtttgggggagctgctcagttaggacccagagggaaccatggaaaccccagcgcagtttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgt

SEQ ID NO: 593660 - DNA, 484 bp, Homo sapiens; identical to SEQ ID NO: 535400
  misc_feature: HIJSMM301DM6DL.46.26.C04.1.454.light.4.raw

SEQ ID NO: 593661 - DNA, 505 bp, Homo sapiens
  misc_feature: HIJSMM301ANU7V.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttatactgtcaacaatattattatactccgccgacgttcggccggggaccgaacgtggaaatcaaacgaactagtggctgcaccatctgtt

SEQ ID NO: 593662 - DNA, 513 bp, Homo sapiens
  misc_feature: HIJSMM301DC8Q6.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggttctcatcgcttctctggctccaaatctggcaacacggcctccctgaccatctctgggctcgagtctgaggacgaggctgattacttctgttgctcttgggcaactactgtcgtttgggtgtcggcggagggaccaagttgaccgtcctaggtcacgcccaaggcctcgccccccgtggtccactctcgtt

SEQ ID NO: 593663 - DNA, 518 bp, Homo sapiens
  misc_feature: HIJSMM301AO9IA.40.74.G08.1.454.light.4.raw
tctagcgactcacgaccggtgctcgatttagtagctctatcagggggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggta

SEQ ID NO: 593664 - DNA, 479 bp, Homo sapiens; identical to SEQ ID NO: 535586
  misc_feature: HIJSMM301EXRI6.13.34.D01.1.454.light.4.raw

SEQ ID NO: 593665 - DNA, 509 bp, Homo sapiens; identical to SEQ ID NO: 541829
  misc_feature: HIJSMM301AV15O.17.28.C06.1.454.light.4.raw

SEQ ID NO: 593666 - DNA, 496 bp, Homo sapiens
  misc_feature: HIJSMM301A02RK.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtcctttctctccaggggagaggagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggatttgcagtgtattactgtcagcagtatcataggtcaaacaccttcggccaagggacacgactggaggattaaaggaactgtggctgcaccatctgtcttcatcttccccg

SEQ ID NO: 593667 - DNA, 489 bp, Homo sapiens; identical to SEQ ID NO: 579541
  misc_feature: HIJSMM301BKP92.22.86.H09.1.454.light.4.raw

SEQ ID NO: 593668 - DNA, 496 bp, Homo sapiens
  misc_feature: HIJSMM301EJPYE.21.27.C05.1.454.light.4.raw
  modified_base (196)..(196): a, c, t, g, unknown or other
tcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtcttcta

SEQ ID NO: 593669 - DNA, 485 bp, Homo sapiens; identical to SEQ ID NO: 536040
  misc_feature: HIJSMM301EVDL0.15.1.A01.1.454.light.4.raw

SEQ ID NO: 593670 - DNA, 511 bp, Homo sapiens
  misc_feature: HIJSMM301ATP41.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaaggctgaccgtcctaggtcagcccaaggctgccccctcggtcactctgttccca

SEQ ID NO: 593671 - DNA, 490 bp, Homo sapiens
  misc_feature: HIJSMM301AYOKU.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggtcaggggaccaagctggagatcaaacgaactgtgg

SEQ ID NO: 593672 - DNA, 520 bp, Homo sapiens
  misc_feature: HIJSMM301E0P19.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggtcggagggaccaggctgaccgtcctaggtcagccaaggctgccccctcggtcactctgttcccacct

SEQ ID NO: 593673 - DNA, 485 bp, Homo sapiens
  misc_feature: HIJSMM301BHSNC.5.34.D01.1.454.light.4.raw
  modified_base (456)..(456): a, c, t, g, unknown or other
atcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgacnggagataaacgaaactgtggctgcaccta

SEQ ID NO: 593674 - DNA, 491 bp, Homo sapiens
  misc_feature: HIJSMM301CL5VP.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctacagactgaagattttgcaacttattttgtcaacaggctaacactttccccctcactttcggcggagggaccaaggtggagatcaagcgaactgtggctgcaccatctgt

SEQ ID NO: 593675 - DNA, 468 bp, Homo sapiens
  misc_feature: HIJSMM301DJ3UG.49.37.D04.1.454.light.4.raw
agtcgagagacacgaccggtgctcgatttagtagcatactgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtgggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaa

SEQ ID NO: 593676 - DNA, 494 bp, Homo sapiens; identical to SEQ ID NO: 534994
  misc_feature: HIJSMM301D0UTG.27.78.H01.1.454.light.4.raw

SEQ ID NO: 593677 - DNA, 512 bp, Homo sapiens
  misc_feature: HIJSMM301BM5Y0.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggtccctcgggaccaaacgtaggagtatcaaacgaactagtggcgtgcaccactctgtt

SEQ ID NO: 593678 - DNA, 503 bp, Homo sapiens; identical to SEQ ID NO: 547397
  misc_feature: HIJSMM301AHC5J.48.34.D01.1.454.light.4.raw

SEQ ID NO: 593679 - DNA, 504 bp, Homo sapiens; identical to SEQ ID NO: 535561
  misc_feature: HIJSMM301EMGNH.4.57.F02.1.454.light.4.raw

SEQ ID NO: 593680 - DNA, 459 bp, Homo sapiens; identical to SEQ ID NO: 547319
  misc_feature: HIJSMM301BJ61Q.22.28.C06.1.454.light.4.raw

SEQ ID NO: 593681 - DNA, 519 bp, Homo sapiens; identical to SEQ ID NO: 555040
  misc_feature: HIJSMM301CJFLK.40.27.C05.1.454.light.4.raw

SEQ ID NO: 593682 - DNA, 488 bp, Homo sapiens
  misc_feature: HIJSMM301A5AN7.48.28.C06.1.454.light.4.raw
agtatacatacacgaccggtgctcgatttagagctcacgtattgggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 593683 - DNA, 489 bp, Homo sapiens
  misc_feature: HIJSMM301AER3W.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcgggaccaaagtaggatatcaaacgaactagtggctgcaccatctgtt

SEQ ID NO: 593684 - DNA, 507 bp, Homo sapiens
  misc_feature: HIJSMM301ADCAN.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccgaacggtggaaagtacaaacgaaactagtggctgcaccat

SEQ ID NO: 593685 - DNA, 505 bp, Homo sapiens; identical to SEQ ID NO: 536117
  misc_feature: HIJSMM301D83CZ.8.71.G05.1.454.light.4.raw

SEQ ID NO: 593686 - DNA, 488 bp, Homo sapiens; identical to SEQ ID NO: 567348
  misc_feature: HIJSMM301AJ1OL.14.55.E11.1.454.light.4.raw

SEQ ID NO: 593687 - DNA, 489 bp, Homo sapiens; identical to SEQ ID NO: 549568
  misc_feature: HIJSMM301DQ00V.43.33.C11.1.454.light.4.raw

SEQ ID NO: 593688 - DNA, 508 bp, Homo sapiens; identical to SEQ ID NO: 535835
  misc_feature: HIJSMM301D03IH.8.34.D01.1.454.light.4.raw

SEQ ID NO: 593689 - DNA, 534 bp, Homo sapiens
  misc_feature: HIJSMM301DJRSL.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctacaaaaagaagtagcccactcgttggtttcgggcgggggaccaaggtcgaccgtcctaagtcgagcccaaggcctcgccccctcggtccactctcgttcccacccctcctcaacg

SEQ ID NO: 593690 - DNA, 497 bp, Homo sapiens; identical to SEQ ID NO: 535664
  misc_feature: HIJSMM301ALEQC.22.14.B03.1.454.light.4.raw

SEQ ID NO: 593691 - DNA, 505 bp, Homo sapiens
  misc_feature: HIJSMM301EONND.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccca

SEQ ID NO: 593692 - DNA, 493 bp, Homo sapiens; identical to SEQ ID NO: 540127
  misc_feature: HIJSMM301BQDFR.10.17.B06.1.454.light.4.raw

SEQ ID NO: 593693 - DNA, 503 bp, Homo sapiens; identical to SEQ ID NO: 591990
  misc_feature: HIJSMM301DXRBL.18.26.C04.1.454.light.4.raw

SEQ ID NO: 593694 - DNA, 475 bp, Homo sapiens
  misc_feature: HIJSMM301CEUK5.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcggacccaggctatggatgaggctgactattactgtcaggcgtgggacagcagcactgcccgctatgtcttcggaactgggaccaaggtcaccgtcctaagtcagcccc

SEQ ID NO: 593695 - DNA, 507 bp, Homo sapiens
  misc_feature: HIJSMM301C0GTS.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtggttcggcggagggaccaagctgaccgtcctacgtcacgccaaggctcgccccctcggtcactctcgttccccg

SEQ ID NO: 593696 - DNA, 491 bp, Homo sapiens; identical to SEQ ID NO: 536211
  misc_feature: HIJSMM301CG39L.16.53.E09.1.454.light.4.raw

SEQ ID NO: 593697 - DNA, 486 bp, Homo sapiens; identical to SEQ ID NO: 535043
  misc_feature: HIJSMM301A46YF.46.35.D02.1.454.light.4.raw

SEQ ID NO: 593698 - DNA, 492 bp, Homo sapiens
  misc_feature: HIJSMM301AEDAK.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggaggatcagacgaactgtggctgcaccactctgtcttcta

SEQ ID NO: 593699 - DNA, 488 bp, Homo sapiens; identical to SEQ ID NO: 537260
  misc_feature: HIJSMM301CXG3V.47.70.G04.1.454.light.4.raw

SEQ ID NO: 593700 - DNA, 490 bp, Homo sapiens; identical to SEQ ID NO: 535234
  misc_feature: HIJSMM301B0OKW.17.21.B10.1.454.light.4.raw

SEQ ID NO: 593701 - DNA, 499 bp, Homo sapiens; identical to SEQ ID NO: 581927
  misc_feature: HIJSMM301BGWWE.40.80.H03.1.454.light.4.raw

SEQ ID NO: 593702 - DNA, 500 bp, Homo sapiens
  misc_feature: HIJSMM301DSS3S.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactggtggctgcacatctgtctcatcttcccgcta

SEQ ID NO: 593703 - DNA, 494 bp, Homo sapiens; identical to SEQ ID NO: 537003
  misc_feature: HIJSMM301BSKBN.10.79.H02.1.454.light.4.raw

SEQ ID NO: 593704 - DNA, 444 bp, Homo sapiens; identical to SEQ ID NO: 535856
  misc_feature: HIJSMM301DXJHB.9.9.A09.1.454.light.4.raw

SEQ ID NO: 593705 - DNA, 499 bp, Homo sapiens; identical to SEQ ID NO: 557364
  misc_feature: HIJSMM301BZIJB.40.57.F02.1.454.light.4.raw

SEQ ID NO: 593706 - DNA, 507 bp, Homo sapiens
  misc_feature: HIJSMM301A21ZS.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggacatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 593707 - DNA, 484 bp, Homo sapiens; identical to SEQ ID NO: 535240
  misc_feature: HIJSMM301B57LC.47.60.F05.1.454.light.4.raw

SEQ ID NO: 593708 - DNA, 510 bp, Homo sapiens
  misc_feature: HIJSMM301D2HJJ.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgacccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccta

SEQ ID NO: 593709 - DNA, 516 bp, Homo sapiens
  misc_feature: HIJSMM301CKE2I.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccccaccctcctccc

SEQ ID NO: 593710 - DNA, 501 bp, Homo sapiens
  misc_feature: HIJSMM301B5DG6.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcactatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 593711 - DNA, 482 bp, Homo sapiens
  misc_feature: HIJSMM301ALL7E.16.81.H04.1.454.light.4.raw
tgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcaccat

SEQ ID NO: 593712 - DNA, 446 bp, Homo sapiens; identical to SEQ ID NO: 537330
  misc_feature: HIJSMM301B65P2.18.9.A09.1.454.light.4.raw

SEQ ID NO: 593713 - DNA, 485 bp, Homo sapiens
  misc_feature: HIJSMM301EPBM9.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataaatctaccactcactttcggcggaggaccacggtggagatcaaacgaactgtggctgcaccatctgtt

SEQ ID NO: 593714 - DNA, 487 bp, Homo sapiens; identical to SEQ ID NO: 549649
  misc_feature: HIJSMM301CSR0R.19.71.G05.1.454.light.4.raw

SEQ ID NO: 593715 - DNA, 513 bp, Homo sapiens; identical to SEQ ID NO: 539678
  misc_feature: HIJSMM301C2BDA.17.37.D04.1.454.light.4.raw

SEQ ID NO: 593716 - DNA, 495 bp, Homo sapiens
  misc_feature: HIJSMM301DWKZ8.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctcctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgcgt

SEQ ID NO: 593717 - DNA, 509 bp, Homo sapiens
  misc_feature: HIJSMM301BJMHK.49.53.E09.1.454.light.4.raw
  modified_base (235)..(235): a, c, t, g, unknown or other
agtcgagagacacgaccggtgctcgatttagagagagtgtgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaaacngtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggtcgggaccaggctgaccgtcctgggtcagccaaggctgccccctcggtcactctgtcccta

SEQ ID NO: 593718 - DNA, 480 bp, Homo sapiens; identical to SEQ ID NO: 535630
  misc_feature: HIJSMM301ENS6P.40.59.F04.1.454.light.4.raw

SEQ ID NO: 593719 - DNA, 497 bp, Homo sapiens; identical to SEQ ID NO: 537300
  misc_feature: HIJSMM301ADB9L.9.53.E09.1.454.light.4.raw

SEQ ID NO: 593720 - DNA, 505 bp, Homo sapiens; identical to SEQ ID NO: 535503
  misc_feature: HIJSMM301AVP24.8.28.C06.1.454.light.4.raw

SEQ ID NO: 593721 - DNA, 519 bp, Homo sapiens; identical to SEQ ID NO: 547780
  misc_feature: HIJSMM301EI52J.5.27.C05.1.454.light.4.raw

SEQ ID NO: 593722 - DNA, 508 bp, Homo sapiens; identical to SEQ ID NO: 581475
  misc_feature: HIJSMM301BR5LE.21.87.H10.1.454.light.4.raw

SEQ ID NO: 593723 - DNA, 503 bp, Homo sapiens
  misc_feature: HIJSMM301CN7HW.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaggctgccccctggtcact

SEQ ID NO: 593724 - DNA, 505 bp, Homo sapiens
  misc_feature: HIJSMM301CHHIU.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcctaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcta

SEQ ID NO: 593725 - DNA, 498 bp, Homo sapiens
  misc_feature: HIJSMM301CHOUU.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccagggaccaaggtggaaatacaaacgaactgtggctgcacc

SEQ ID NO: 593726 - DNA, 493 bp, Homo sapiens
  misc_feature: HIJSMM301A07WQ.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcgcggagggaccaaggtggagatcaaacgaactgtggctgcaccatctgtcttcatt

SEQ ID NO: 593727 - DNA, 514 bp, Homo sapiens
  misc_feature: HIJSMM301AIKEN.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccgacactgaccgtcctaggtcagccaaggctgccccctcggtcactctgtt

SEQ ID NO: 593728 - DNA, 499 bp, Homo sapiens
  misc_feature: HIJSMM301CO8Z9.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtctaggtcagcccaaggccaacccactgtcact

SEQ ID NO: 593729 - DNA, 491 bp, Homo sapiens
  misc_feature: HIJSMM301C8Y3G.12.67.G01.1.454.light.4.raw
atacgacgtacacgaccggtgctcgatttagagtatacatattgggtttggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagacgcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctagtcagcccaaggcccaacccactgtcactctgttccccaccctcctctacgtcgtat

SEQ ID NO: 593730 - DNA, 494 bp, Homo sapiens
  misc_feature: HIJSMM301CQASK.13.6.A06.1.454.light.4.raw
  modified_base (483)..(483): a, c, t, g, unknown or other
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactgtggctgcnccatctgtctt

SEQ ID NO: 593731 - DNA, 505 bp, Homo sapiens; identical to SEQ ID NO: 558240
  misc_feature: HIJSMM301D5ICH.40.67.G01.1.454.light.4.raw

SEQ ID NO: 593732 - DNA, 497 bp, Homo sapiens; identical to SEQ ID NO: 536371
  misc_feature: HIJSMM301C99AL.16.78.H01.1.454.light.4.raw

SEQ ID NO: 593733 - DNA, 489 bp, Homo sapiens; identical to SEQ ID NO: 536663
  misc_feature: HIJSMM301BG8N4.16.72.G06.1.454.light.4.raw

SEQ ID NO: 593734 - DNA, 505 bp, Homo sapiens; identical to SEQ ID NO: 552248
  misc_feature: HIJSMM301AF9M7.11.67.G01.1.454.light.4.raw

SEQ ID NO: 593735 - DNA, 496 bp, Homo sapiens
  misc_feature: HIJSMM301CYLRL.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtggaccatggtcaccgtcctaggtcagcccaagaccaaccccactgt

SEQ ID NO: 593736 - DNA, 518 bp, Homo sapiens
  misc_feature: HIJSMM301AZDPD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaaggtaggaaagtacaaaaccgaaactacgttggctgcaccaactctgtcttctatcttcccccg

SEQ ID NO: 593737 - DNA, 521 bp, Homo sapiens; identical to SEQ ID NO: 539470
  misc_feature: HIJSMM301CJH6C.27.23.C01.1.454.light.4.raw

SEQ ID NO: 593738 - DNA, 483 bp, Homo sapiens; identical to SEQ ID NO: 545669
  misc_feature: HIJSMM301EBYX2.13.8.A08.1.454.light.4.raw

SEQ ID NO: 593739 - DNA, 475 bp, Homo sapiens
  misc_feature: HIJSMM301CQQ49.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 593740 - DNA, 501 bp, Homo sapiens; identical to SEQ ID NO: 550139
  misc_feature: HIJSMM301D4JS9.15.56.F01.1.454.light.4.raw

SEQ ID NO: 593741 - DNA, 493 bp, Homo sapiens; identical to SEQ ID NO: 535657
  misc_feature: HIJSMM301DXPLV.27.78.H01.1.454.light.4.raw

SEQ ID NO: 593742 - DNA, 492 bp, Homo sapiens
  misc_feature: HIJSMM301DDGJN.18.11.A11.1.454.light.4.raw
  modified_base (460)..(460): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgnggctgcaccatctgtcttcatcttcccgccat

SEQ ID NO: 593743 - DNA, 490 bp, Homo sapiens; identical to SEQ ID NO: 535234
  misc_feature: HIJSMM301B33YF.17.21.B10.1.454.light.4.raw

SEQ ID NO: 593744 - DNA, 494 bp, Homo sapiens; identical to SEQ ID NO: 540110
  misc_feature: HIJSMM301EIYNQ.51.71.G05.1.454.light.4.raw

SEQ ID NO: 593745 - DNA, 509 bp, Homo sapiens; identical to SEQ ID NO: 535670
  misc_feature: HIJSMM301BK28R.47.23.C01.1.454.light.4.raw

SEQ ID NO: 593746 - DNA, 484 bp, Homo sapiens; identical to SEQ ID NO: 535240
  misc_feature: HIJSMM301ED1JQ.47.60.F05.1.454.light.4.raw

SEQ ID NO: 593747 - DNA, 498 bp, Homo sapiens
  misc_feature: HIJSMM301B9J5B.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaacccgttactttcggcggagggaccaaggtggagatcaaacgaactgtggctgcaccatctgtcttcatcttccccg

SEQ ID NO: 593748 - DNA, 517 bp, Homo sapiens
  misc_feature: HIJSMM301A3X1O.22.30.C08.1.454.light.4.raw
  modified_base (506)..(506): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccnccctcctcacg

SEQ ID NO: 593749 - DNA, 454 bp, Homo sapiens; identical to SEQ ID NO: 535005
  misc_feature: HIJSMM301AHLOB.19.86.H09.1.454.light.4.raw

SEQ ID NO: 593750 - DNA, 495 bp, Homo sapiens; identical to SEQ ID NO: 554164
  misc_feature: HIJSMM301CHJ4X.27.78.H01.1.454.light.4.raw

SEQ ID NO: 593751 - DNA, 514 bp, Homo sapiens; identical to SEQ ID NO: 547648
  misc_feature: HIJSMM301CEWLF.16.1.A01.1.454.light.4.raw

SEQ ID NO: 593752 - DNA, 504 bp, Homo sapiens
  misc_feature: HIJSMM301EKFTE.15.25.C03.1.454.light.4.raw
tctacgtagccacgaccggtgctcgatttagtagtgtagatttgggtttgggggatcaggactcctcagttcaccttctcacaatgaggctccctgctcagctcctggggcgtgctaatgctctgggtctctggatccagtggggagtattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccatctgt

SEQ ID NO: 593753 - DNA, 494 bp, Homo sapiens
  misc_feature: HIJSMM301EGNI8.3.26.C04.1.454.light.4.raw
agacgcactccacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtctccatcacttgccgggccagtcagagtattagtcgctggttggcctggtatcagcagaaaccagggaaagcccctaagctcctgatctatcaggcgtctagtttacaaagtggggtcccatcaaggttcagcggcagtggatctgggacagaattcactctcaccatcagcagcctgcagcctgatgattttgcaacttattactgccaacagtataatacttattggacgttcggtccaagggaccaaggtggaaatacaaacgaactagtggctgcaccatctgtcttcta

SEQ ID NO: 593754 - DNA, 491 bp, Homo sapiens; identical to SEQ ID NO: 536211
  misc_feature: HIJSMM301D7NXO.16.53.E09.1.454.light.4.raw

SEQ ID NO: 593755 - DNA, 489 bp, Homo sapiens; identical to SEQ ID NO: 535139
  misc_feature: HIJSMM301EMOE1.14.55.E11.1.454.light.4.raw

SEQ ID NO: 593756 - DNA, 490 bp, Homo sapiens
  misc_feature: HIJSMM301ANQE8.17.21.B10.1.454.light.4.raw
  modified_base (489)..(489): a, c, t, g, unknown or other
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgna

SEQ ID NO: 593757 - DNA, 485 bp, Homo sapiens; identical to SEQ ID NO: 535985
  misc_feature: HIJSMM301DUCG2.15.1.A01.1.454.light.4.raw

SEQ ID NO: 593758 - DNA, 507 bp, Homo sapiens; identical to SEQ ID NO: 538702
  misc_feature: HIJSMM301AWAMS.11.57.F02.1.454.light.4.raw

SEQ ID NO: 593759 - DNA, 479 bp, Homo sapiens; identical to SEQ ID NO: 535188
  misc_feature: HIJSMM301EOBCS.10.74.G08.1.454.light.4.raw

SEQ ID NO: 593760 - DNA, 497 bp, Homo sapiens
  misc_feature: HIJSMM301D3A4I.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggtcggagggaccaagctgaccgtcctaggtcagcccaaggctgcccctcggt

SEQ ID NO: 593761 - DNA, 489 bp, Homo sapiens; identical to SEQ ID NO: 535139
  misc_feature: HIJSMM301EQT9M.14.55.E11.1.454.light.4.raw

SEQ ID NO: 593762 - DNA, 482 bp, Homo sapiens
  misc_feature: HIJSMM301EGPD1.5.70.G04.1.454.light.4.raw
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtctaacaggctcagagtttcccgctcactttcggcggagggaccaaggtggagatccaaacgaactgtggctgca

SEQ ID NO: 593763 - DNA, 506 bp, Homo sapiens
  misc_feature: HIJSMM301D1020.13.25.C03.1.454.light.4.raw
tcacgtactacacgaccggtgctcgatttagtagtgtagatttgggtttgggggggtcacaagaggcagcgctctcgggacgtctccgccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggaggtccaaagtgaccgtcctaggtcagcccaaggctcgccccctcggtcactcc

SEQ ID NO: 593764 - DNA, 512 bp, Homo sapiens
  misc_feature: HIJSMM301CTCMA.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttcccaccctcctcta

SEQ ID NO: 593765 - DNA, 492 bp, Homo sapiens
  misc_feature: HIJSMM301DUL38.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccaggggtggagatcagacgaactgtggctgcaccatctgtt

SEQ ID NO: 593766 - DNA, 508 bp, Homo sapiens
  misc_feature: HIJSMM301D68C2.49.31.C09.1.454.light.4.raw
agtcgagagacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtattcggcggagggaccaagctgaccgtcctaggtcagcccaaggctgccccctcggtcactctgttcccta

SEQ ID NO: 593767 - DNA, 512 bp, Homo sapiens
  misc_feature: HIJSMM301ATTHV.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcccaaccccactgtcactcc

SEQ ID NO: 593768 - DNA, 484 bp, Homo sapiens; identical to SEQ ID NO: 535240
  misc_feature: HIJSMM301EOGHA.47.60.F05.1.454.light.4.raw

SEQ ID NO: 593769 - DNA, 520 bp, Homo sapiens; identical to SEQ ID NO: 539176
  misc_feature: HIJSMM301DYXDY.27.23.C01.1.454.light.4.raw

SEQ ID NO: 593770 - DNA, 513 bp, Homo sapiens; identical to SEQ ID NO: 576307
  misc_feature: HIJSMM301CRHZF.40.46.E02.1.454.light.4.raw

SEQ ID NO: 593771 - DNA, 491 bp, Homo sapiens
  misc_feature: HIJSMM301B7RQ6.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggcccaagggacacgactggagattaaacgaactgtggctgcaccatctgtcttcat

SEQ ID NO: 593772 - DNA, 508 bp, Homo sapiens
  misc_feature: HIJSMM301A5URA.48.67.G01.1.454.light.4.raw
agtatacatacacgaccggtgctcgatttagagtatacatattgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagtattttacattttatactgtcagcagtatcgtaagtggactccgacgtttggaccaagggaccaaggtggaagtcaaacgaactgtggctgcaccatctgtcttcatccttcccgcta

SEQ ID NO: 593773 - DNA, 446 bp, Homo sapiens
  misc_feature: HIJSMM301DZ5R0.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctcatactcgta

SEQ ID NO: 593774 - DNA, 487 bp, Homo sapiens; identical to SEQ ID NO: 536206
  misc_feature: HIJSMM301BZD79.47.38.D05.1.454.light.4.raw

SEQ ID NO: 593775 - DNA, 525 bp, Homo sapiens
  misc_feature: HIJSMM301ASM0N.7.86.H09.1.454.light.4.raw
cgtgtctctacacgaccggtgctcgatttagtgctatagacttgggtttggggaggagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgtcaacggacaaggtaggcgatacaacgaactacgtggcgtgcaccactctcgtcttctactcttccccg

SEQ ID NO: 593776 - DNA, 503 bp, Homo sapiens; identical to SEQ ID NO: 545379
  misc_feature: HIJSMM301BTYZ2.9.53.E09.1.454.light.4.raw

SEQ ID NO: 593777 - DNA, 492 bp, Homo sapiens; identical to SEQ ID NO: 570661
  misc_feature: HIJSMM301E05QQ.5.57.F02.1.454.light.4.raw

SEQ ID NO: 593778 - DNA, 488 bp, Homo sapiens; identical to SEQ ID NO: 537124
  misc_feature: HIJSMM301CZ4D1.11.25.C03.1.454.light.4.raw

SEQ ID NO: 593779 - DNA, 494 bp, Homo sapiens; identical to SEQ ID NO: 534994
  misc_feature: HIJSMM301A9M10.27.78.H01.1.454.light.4.raw

SEQ ID NO: 593780 - DNA, 497 bp, Homo sapiens
  misc_feature: HIJSMM301CK820.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctcg

SEQ ID NO: 593781 - DNA, 495 bp, Homo sapiens; identical to SEQ ID NO: 538920
  misc_feature: HIJSMM301BJG8J.47.64.F09.1.454.light.4.raw

SEQ ID NO: 593782 - DNA, 504 bp, Homo sapiens; identical to SEQ ID NO: 553842
  misc_feature: HIJSMM301EVHLK.16.9.A09.1.454.light.4.raw

SEQ ID NO: 593783 - DNA, 493 bp, Homo sapiens; identical to SEQ ID NO: 540693
  misc_feature: HIJSMM301BSAWD.22.65.F10.1.454.light.4.raw

SEQ ID NO: 593784 - DNA, 476 bp, Homo sapiens
  misc_feature: HIJSMM301C83ZJ.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccaggaccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtcct

SEQ ID NO: 593785 - DNA, 479 bp, Homo sapiens; identical to SEQ ID NO: 538734
  misc_feature: HIJSMM301AZBIS.8.53.E09.1.454.light.4.raw

SEQ ID NO: 593786 - DNA, 509 bp, Homo sapiens; identical to SEQ ID NO: 553073
  misc_feature: HIJSMM301DNQGQ.16.1.A01.1.454.light.4.raw

SEQ ID NO: 593787 - DNA, 482 bp, Homo sapiens
  misc_feature: HIJSMM301B9DJG.48.19.B08.1.454.light.4.raw
agtatacatacacgaccggtgctcgatttagtgagtcagtaaggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccc

SEQ ID NO: 593788 - DNA, 505 bp, Homo sapiens
  misc_feature: HIJSMM301AQJWI.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcgagggtccaaagtgaccgtcctaggtcagcccaaggctgccccctcggtcactc

SEQ ID NO: 593789 - DNA, 479 bp, Homo sapiens; identical to SEQ ID NO: 558912
  misc_feature: HIJSMM301D3MNQ.40.23.C01.1.454.light.4.raw

SEQ ID NO: 593790 - DNA, 498 bp, Homo sapiens; identical to SEQ ID NO: 536848
  misc_feature: HIJSMM301DSEW4.12.26.C04.1.454.light.4.raw

SEQ ID NO: 593791 - DNA, 479 bp, Homo sapiens; identical to SEQ ID NO: 535188
  misc_feature: HIJSMM301DBAGL.10.74.G08.1.454.light.4.raw

SEQ ID NO: 593792 - DNA, 497 bp, Homo sapiens; identical to SEQ ID NO: 536371
  misc_feature: HIJSMM301ET1NA.16.78.H01.1.454.light.4.raw

SEQ ID NO: 593793 - DNA, 512 bp, Homo sapiens
  misc_feature: HIJSMM301D3ZCQ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgactttcggccctcgggaccgaaagtaggatatcaaacgaacgtagtggctgcaccatctcgtctt

SEQ ID NO: 593794 - DNA, 474 bp, Homo sapiens; identical to SEQ ID NO: 537034
  misc_feature: HIJSMM301DPIA5.5.15.B04.1.454.light.4.raw

SEQ ID NO: 593795 - DNA, 480 bp, Homo sapiens
  misc_feature: HIJSMM301C77LK.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaacacagcctccctgaccattactggactccagcctgaggacgaggctgactattactgctcagcatgggacagcggcctcaggacttatgtcttcggaactcgggacccacgttaccgtctaggtca

SEQ ID NO: 593796 - DNA, 487 bp, Homo sapiens; identical to SEQ ID NO: 536206
  misc_feature: HIJSMM301CBMMH.47.38.D05.1.454.light.4.raw

SEQ ID NO: 593797 - DNA, 493 bp, Homo sapiens; identical to SEQ ID NO: 535084
  misc_feature: HIJSMM301EAON5.47.64.F09.1.454.light.4.raw

SEQ ID NO: 593798 - DNA, 503 bp, Homo sapiens
  misc_feature: HIJSMM301C8F3O.5.59.F04.1.454.light.4.raw
atcagacacgcacgaccggtgctcgatttagtacacacacttagggattggggagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccagggaccaaggtggaatacaaacgaactagtggctgcgaccatctgtcttcatcttccccg

SEQ ID NO: 593799 - DNA, 482 bp, Homo sapiens; identical to SEQ ID NO: 535352
  misc_feature: HIJSMM301ADQUU.16.81.H04.1.454.light.4.raw

SEQ ID NO: 593800 - DNA, 524 bp, Homo sapiens
  misc_feature: HIJSMM301BI5OO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctggaggacgaggctgattatttattgtagttcatatacaaccagtgacacgttgggtgttcggcggagggaccaggctgaccgtcctaggtcagccaaggctcgccccctcggtcactctcgttcccaccct

SEQ ID NO: 593801 - DNA, 467 bp, Homo sapiens; identical to SEQ ID NO: 538403
  misc_feature: HIJSMM301BKE06.41.48.E04.1.454.light.4.raw

SEQ ID NO: 593802 - DNA, 488 bp, Homo sapiens; identical to SEQ ID NO: 535125
  misc_feature: HIJSMM301AHMSX.17.25.C03.1.454.light.4.raw

SEQ ID NO: 593803 - DNA, 514 bp, Homo sapiens
  misc_feature: HIJSMM301C3BDX.13.4.A04.1.454.light.4.raw
  modified_base (500)..(500): a, c, t, g, unknown or other
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggaccagaccctggagcctcagttggaagcagccgatccagcctgcggagccgtggtgggcaggtcacggcccaaggcccaaccccnctgtcactctcgtt

SEQ ID NO: 593804 - DNA, 483 bp, Homo sapiens
  misc_feature: HIJSMM301DOSMP.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccagggaccaaggtggaaatcaaacgaactgtgg

SEQ ID NO: 593805 - DNA, 511 bp, Homo sapiens; identical to SEQ ID NO: 537047
  misc_feature: HIJSMM301BURYY.5.27.C05.1.454.light.4.raw

SEQ ID NO: 593806 - DNA, 499 bp, Homo sapiens
  misc_feature: HIJSMM301DSVD9.5.55.E11.1.454.light.4.raw
  modified_base (497)..(497): a, c, t, g, unknown or other
atcagacacgcacgaccggtgctcgatttagcactcgcacgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttattactgtcagcaatattttattactcctctgacgttcggccaagggaccaaggtggaaaatacaaacgaaactgtggctgnaa

SEQ ID NO: 593807 - DNA, 355 bp, Homo sapiens
  misc_feature: HIJSMM301BVU9X.40.9.A09.1.454.light.4.raw
tctagcgactcacgaccggtgctcgatttagcgagacgcgcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggaacaacctcctaagttgctcttttactgggcgtcttcccgggagtccggggtccctgaccgattcagtgccagcgggtctgggacagacttcactctcacca

SEQ ID NO: 593808 - DNA, 506 bp, Homo sapiens
  misc_feature: HIJSMM301AY7XA.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaaactgtggctgcaccatctgt

SEQ ID NO: 593809 - DNA, 505 bp, Homo sapiens; identical to SEQ ID NO: 535987
  misc_feature: HIJSMM301C47W5.18.37.D04.1.454.light.4.raw

SEQ ID NO: 593810 - DNA, 496 bp, Homo sapiens; identical to SEQ ID NO: 535541
  misc_feature: HIJSMM301C33WX.3.33.C11.1.454.light.4.raw

SEQ ID NO: 593811 - DNA, 490 bp, Homo sapiens
  misc_feature: HIJSMM301D5JJF.21.46.E02.1.454.light.4.raw
tcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgaccgtcctaggtcagcccaaggctgccccctc

SEQ ID NO: 593812 - DNA, 492 bp, Homo sapiens; identical to SEQ ID NO: 535426
  misc_feature: HIJSMM301BLI34.47.78.H01.1.454.light.4.raw

SEQ ID NO: 593813 - DNA, 493 bp, Homo sapiens; identical to SEQ ID NO: 540179
  misc_feature: HIJSMM301BWG1D.27.78.H01.1.454.light.4.raw

SEQ ID NO: 593814 - DNA, 496 bp, Homo sapiens; identical to SEQ ID NO: 537925
  misc_feature: HIJSMM301EYE51.22.14.B03.1.454.light.4.raw

SEQ ID NO: 593815 - DNA, 493 bp, Homo sapiens; identical to SEQ ID NO: 536969
  misc_feature: HIJSMM301B67R5.27.78.H01.1.454.light.4.raw

SEQ ID NO: 593816 - DNA, 515 bp, Homo sapiens
  misc_feature: HIJSMM301AT5Y4.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctggctccagactgaggacgaggctgattattacttgcagctcacatacaagacggcagcggttgggtggttcggcggggggaccgacactgaccgtcctaggtcagccaaggctgccccctcggtcactctgtt

SEQ ID NO: 593817 - DNA, 487 bp, Homo sapiens
  misc_feature: HIJSMM301CHUEG.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtaccccgtacacttttggccaggggaccaaactggacatcaaacgaactgtggctgcaccatctgtt

SEQ ID NO: 593818 - DNA, 505 bp, Homo sapiens
  misc_feature: HIJSMM301EIWVY.13.55.E11.1.454.light.4.raw
tcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacattctggcctttcacttttcggccctgggaccaaagtggataccaatcgaactgtggctgcaccatctgtt

SEQ ID NO: 593819 - DNA, 491 bp, Homo sapiens; identical to SEQ ID NO: 546499
  misc_feature: HIJSMM301DVT7L.48.35.D02.1.454.light.4.raw

SEQ ID NO: 593820 - DNA, 494 bp, Homo sapiens; identical to SEQ ID NO: 534994
  misc_feature: HIJSMM301AUFIM.27.78.H01.1.454.light.4.raw

SEQ ID NO: 593821 - DNA, 485 bp, Homo sapiens
  misc_feature: HIJSMM301DL3EZ.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtccgctcactttcggcggaggaccaaggtggagatcaaacgtaacg

SEQ ID NO: 593822 - DNA, 444 bp, Homo sapiens; identical to SEQ ID NO: 535192
  misc_feature: HIJSMM301C9AFA.5.9.A09.1.454.light.4.raw

SEQ ID NO: 593823 - DNA, 506 bp, Homo sapiens; identical to SEQ ID NO: 563474
  misc_feature: HIJSMM301EFTET.10.27.C05.1.454.light.4.raw

SEQ ID NO: 593824 - DNA, 508 bp, Homo sapiens; identical to SEQ ID NO: 537871
  misc_feature: HIJSMM301AVZ1P.8.33.C11.1.454.light.4.raw

SEQ ID NO: 593825 - DNA, 515 bp, Homo sapiens
  misc_feature: HIJSMM301BVQZX.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttcccaccctcct

SEQ ID NO: 593826 - DNA, 505 bp, Homo sapiens
  misc_feature: HIJSMM301C0RRR.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcacgcccaaggccaactccactgtcact

SEQ ID NO: 593827 - DNA, 485 bp, Homo sapiens; identical to SEQ ID NO: 535501
  misc_feature: HIJSMM301DE4SD.3.10.A10.1.454.light.4.raw

SEQ ID NO: 593828 - DNA, 498 bp, Homo sapiens; identical to SEQ ID NO: 553247
  misc_feature: HIJSMM301EAWFX.40.57.F02.1.454.light.4.raw

SEQ ID NO: 593829 - DNA, 506 bp, Homo sapiens; identical to SEQ ID NO: 550551
  misc_feature: HIJSMM301DD7CU.16.1.A01.1.454.light.4.raw

SEQ ID NO: 593830 - DNA, 479 bp, Homo sapiens
  misc_feature: HIJSMM301EWM1G.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttattctgccagcaatataatagttattggacgttcggccaggggaccaaggtcgaaatgagacgaactgtggctgcacc

SEQ ID NO: 593831 - DNA, 484 bp, Homo sapiens
  misc_feature: HIJSMM301D1SR8.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggccaaggtggagatcaaacgaac

SEQ ID NO: 593832 - DNA, 507 bp, Homo sapiens
  misc_feature: HIJSMM301BAI11.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccacctgaccatcagcagggtcgaagccggggatgaggccgactattactgtcaggtgtgggctggtgataatgatcatgcgggggtgttcggcggagggaccaaggctgaccgtcctaagtcagcccaaggctgccccctggtcactctcg

SEQ ID NO: 593833 - DNA, 441 bp, Homo sapiens; identical to SEQ ID NO: 551059
  misc_feature: HIJSMM301CBHFZ.11.3.A03.1.454.light.4.raw
  modified_base (423)..(423): a, c, t, g, unknown or other

SEQ ID NO: 593834 - DNA, 493 bp, Homo sapiens
  misc_feature: HIJSMM301A0A92.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcgccaagggacacgactggagattaaacgaactgtggctgcaccatctgtctt

SEQ ID NO: 593835 - DNA, 489 bp, Homo sapiens; identical to SEQ ID NO: 535139
  misc_feature: HIJSMM301D09KB.14.55.E11.1.454.light.4.raw

SEQ ID NO: 593836 - DNA, 499 bp, Homo sapiens; identical to SEQ ID NO: 543360
  misc_feature: HIJSMM301C5RHS.19.78.H01.1.454.light.4.raw

SEQ ID NO: 593837 - DNA, 489 bp, Homo sapiens
  misc_feature: HIJSMM301B2XWS.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgctaacttacttttgtcaacagactaactcattccctcgcagttttggccaggggaccaaggtggagatcaaacgaactgtggctgcaccatctgtcttcatt

SEQ ID NO: 593838 - DNA, 488 bp, Homo sapiens; identical to SEQ ID NO: 535990
  misc_feature: HIJSMM301CO3LW.11.28.C06.1.454.light.4.raw

SEQ ID NO: 593839 - DNA, 506 bp, Homo sapiens; identical to SEQ ID NO: 537290
  misc_feature: HIJSMM301EJTQM.13.11.A11.1.454.light.4.raw

SEQ ID NO: 593840 - DNA, 501 bp, Homo sapiens; identical to SEQ ID NO: 542364
  misc_feature: HIJSMM301EFALD.7.71.G05.1.454.light.4.raw

SEQ ID NO: 593841 - DNA, 504 bp, Homo sapiens; identical to SEQ ID NO: 539091
  misc_feature: HIJSMM301CIGC2.8.28.C06.1.454.light.4.raw

SEQ ID NO: 593842 - DNA, 486 bp, Homo sapiens; identical to SEQ ID NO: 548936
  misc_feature: HIJSMM301BV9RR.5.55.E11.1.454.light.4.raw

SEQ ID NO: 593843 - DNA, 493 bp, Homo sapiens
  misc_feature: HIJSMM301EM0WH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaacaccttcggccaaggacacgactggagataaaggaactagtggctgcaccatctgtcttctatcttccccg

SEQ ID NO: 593844 - DNA, 505 bp, Homo sapiens; identical to SEQ ID NO: 574950
  misc_feature: HIJSMM301A82KM.15.1.A01.1.454.light.4.raw

SEQ ID NO: 593845 - DNA, 495 bp, Homo sapiens; identical to SEQ ID NO: 539288
  misc_feature: HIJSMM301CAQIX.9.1.A01.1.454.light.4.raw

SEQ ID NO: 593846 - DNA, 521 bp, Homo sapiens; identical to SEQ ID NO: 539470
  misc_feature: HIJSMM301ARAVN.27.23.C01.1.454.light.4.raw

SEQ ID NO: 593847 - DNA, 484 bp, Homo sapiens; identical to SEQ ID NO: 535400
  misc_feature: HIJSMM301CGUMF.46.26.C04.1.454.light.4.raw

SEQ ID NO: 593848 - DNA, 457 bp, Homo sapiens; identical to SEQ ID NO: 561051
  misc_feature: HIJSMM301CO8R0.18.78.H01.1.454.light.4.raw

SEQ ID NO: 593849 - DNA, 490 bp, Homo sapiens
  misc_feature: HIJSMM301BFERK.21.46.E02.1.454.light.4.raw
tcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgaccgtcctaggtcagcccaagctgccccctc

SEQ ID NO: 593850 - DNA, 489 bp, Homo sapiens; identical to SEQ ID NO: 535139
  misc_feature: HIJSMM301EIF9I.14.55.E11.1.454.light.4.raw

SEQ ID NO: 593851 - DNA, 503 bp, Homo sapiens; identical to SEQ ID NO: 565504
  misc_feature: HIJSMM301EJ17O.41.35.D02.1.454.light.4.raw

SEQ ID NO: 593852 - DNA, 504 bp, Homo sapiens
  misc_feature: HIJSMM301EFHBR.41.26.C04.1.454.light.4.raw
tctatactatcacgaccggtgctcgatttagtctagcgactttgggtttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 593853 - DNA, 511 bp, Homo sapiens
  misc_feature: HIJSMM301ECNT4.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccgacggaccgacacgtagaatagagacgaactagtggtcgtgtcaccgatactgtcttctatcttcccgt

SEQ ID NO: 593854 - DNA, 480 bp, Homo sapiens
  misc_feature: HIJSMM301BU1VX.51.72.G06.1.454.light.4.raw
cgatcgtatacacgaccggtgctcgatttagctacgactgcaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcacc

SEQ ID NO: 593855 - DNA, 499 bp, Homo sapiens
  misc_feature: HIJSMM301A94Z4.3.10.A10.1.454.light.4.raw
agacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagccaggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttattctgtcagcagtacaataattggcctttgacgttcggccaagggaccaaggtggaaactaaacgaactgtggctgcaccatctgtcttcatcttcccgccta

SEQ ID NO: 593856 - DNA, 482 bp, Homo sapiens; identical to SEQ ID NO: 541033
  misc_feature: HIJSMM301B44KH.4.27.C05.1.454.light.4.raw

SEQ ID NO: 593857 - DNA, 486 bp, Homo sapiens; identical to SEQ ID NO: 535458
  misc_feature: HIJSMM301AKUI5.7.75.G09.1.454.light.4.raw

SEQ ID NO: 593858 - DNA, 538 bp, Homo sapiens
  misc_feature: HIJSMM301BTD0P.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcgacgggggcccaggcagacgatgaatgtgattatcactgcgttcctttatggtggggcggtggctagtttggggttggttcgggcgggagggaaccgaaacgtcgtaccgtccgtaggtcacgcccgaaggctcgccccctcggtccactccttccg

SEQ ID NO: 593859 - DNA, 383 bp, Homo sapiens; identical to SEQ ID NO: 447524
  misc_feature: HIJSMM301CPRAS.41.26.C04.1.454.light.4.raw

SEQ ID NO: 593860 - DNA, 480 bp, Homo sapiens
  misc_feature: HIJSMM301BPKBK.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggccagggaaccgaaggtaggag

SEQ ID NO: 593861 - DNA, 509 bp, Homo sapiens; identical to SEQ ID NO: 553073
  misc_feature: HIJSMM301ERB5R.16.1.A01.1.454.light.4.raw

SEQ ID NO: 593862 - DNA, 506 bp, Homo sapiens; identical to SEQ ID NO: 563474
  misc_feature: HIJSMM301BFXF1.10.27.C05.1.454.light.4.raw

SEQ ID NO: 593863 - DNA, 492 bp, Homo sapiens; identical to SEQ ID NO: 540272
  misc_feature: HIJSMM301A9A2K.41.23.C01.1.454.light.4.raw

SEQ ID NO: 593864 - DNA, 495 bp, Homo sapiens; identical to SEQ ID NO: 535596
  misc_feature: HIJSMM301C2Y09.10.79.H02.1.454.light.4.raw

SEQ ID NO: 593865 - DNA, 505 bp, Homo sapiens; identical to SEQ ID NO: 539433
  misc_feature: HIJSMM301D92JZ.2.35.D02.1.454.light.4.raw

SEQ ID NO: 593866 - DNA, 509 bp, Homo sapiens
  misc_feature: HIJSMM301AEJG3.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgatttattactgcagctcatattcaggcagcaacagggtattcggcggagggaccaagttgaccgtcctaggtcagcccaaggctgccccctcggtcactctgttcccaccct

SEQ ID NO: 593867 - DNA, 509 bp, Homo sapiens
  misc_feature: HIJSMM301C2NFA.43.38.D05.1.454.light.4.raw
tgtgagtagtcacgaccggtgctcgatttagtatctgatagttgggtttggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtcggggtcccctcaaggttcagcggcagtgcatctgggacagatttcactctcaccatcagcagcctgcagcctgatgattttgcaacttattactgtcaacagtataatagttacccctggacgttcggccgaacgggaccgagggtaggaaagtacaaacgaactagtggctgcaccatctgtcttcatcttccccg

SEQ ID NO: 593868 - DNA, 501 bp, Homo sapiens; identical to SEQ ID NO: 536142
  misc_feature: HIJSMM301BAZIE.15.1.A01.1.454.light.4.raw

SEQ ID NO: 593869 - DNA, 506 bp, Homo sapiens
  misc_feature: HIJSMM301C9P4C.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtctaggtcagcccaaggccaacccactgtcact

SEQ ID NO: 593870 - DNA, 500 bp, Homo sapiens; identical to SEQ ID NO: 546613
  misc_feature: HIJSMM301BN6Z7.11.21.B10.1.454.light.4.raw

SEQ ID NO: 593871 - DNA, 497 bp, Homo sapiens; identical to SEQ ID NO: 545672
  misc_feature: HIJSMM301AMB0T.2.49.E05.1.454.light.4.raw

SEQ ID NO: 593872 - DNA, 497 bp, Homo sapiens
  misc_feature: HIJSMM301AO772.27.78.H01.1.454.light.4.raw
  modified_base (398)..(398): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttnttactgtcatcagagtactactttacctcaagtgatcgaccttcggccaagggacacgactggagattaaacgaactgtggctgcaccatcctgttctt

SEQ ID NO: 593873 - DNA, 491 bp, Homo sapiens
  misc_feature: HIJSMM301B1L3F.47.70.G04.1.454.light.4.raw
agctcacgtacacgaccggtgctcgatttagtgtagtgtgaaggggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccgggggtaccaaactggacatcaacgaactgtggctgcacactctgtctt

SEQ ID NO: 593874 - DNA, 486 bp, Homo sapiens
  misc_feature: HIJSMM301ETBJN.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttccccaccctcctctacgtgagct

SEQ ID NO: 593875 - DNA, 511 bp, Homo sapiens
  misc_feature: HIJSMM301EQEAG.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcagggtttctcatcgcttctctggctccaaatctggcaacacggcctcctgaccatctctgggctcgagtctgaggacgaggctgattactctgttgctcttgggcaactactgtcgtttgggtgttcggcggagggaccaagttgaccgtcctaggtcagcccaaggctgccccctcggtcactctgttccccg

SEQ ID NO: 593876 - DNA, 444 bp, Homo sapiens; identical to SEQ ID NO: 540477
  misc_feature: HIJSMM301BB28J.17.21.B10.1.454.light.4.raw

SEQ ID NO: 593877 - DNA, 496 bp, Homo sapiens; identical to SEQ ID NO: 550221
  misc_feature: HIJSMM301B1CAB.10.79.H02.1.454.light.4.raw

SEQ ID NO: 593878 - DNA, 486 bp, Homo sapiens; identical to SEQ ID NO: 535043
  misc_feature: HIJSMM301A7B3F.46.35.D02.1.454.light.4.raw

SEQ ID NO: 593879 - DNA, 514 bp, Homo sapiens
  misc_feature: HIJSMM301CTKS0.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcgggagggaccaggctgaccgtcctaagtcagcccaaggctgccccctcggtcact

SEQ ID NO: 593880 - DNA, 500 bp, Homo sapiens
  misc_feature: HIJSMM301D0EL8.52.36.D03.1.454.light.4.raw
cgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgacctcctacgtcagcccaaggctcgccccctcggtcacttcc

SEQ ID NO: 593881 - DNA, 501 bp, Homo sapiens; identical to SEQ ID NO: 577508
  misc_feature: HIJSMM301C8MMV.19.78.H01.1.454.light.4.raw

SEQ ID NO: 593882 - DNA, 508 bp, Homo sapiens
  misc_feature: HIJSMM301CF586.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcacgcccaacggctcgccccctcggtcta

SEQ ID NO: 593883 - DNA, 482 bp, Homo sapiens
  misc_feature: HIJSMM301ERZ4D.48.45.E01.1.454.light.4.raw
  modified_base (414)..(414): a, c, t, g, unknown or other
agtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttcngctgctcatatgcagccaactattatgtcttcggaactgagaccaaggtcaccgtcctaggtcagccc

SEQ ID NO: 593884 - DNA, 519 bp, Homo sapiens
  misc_feature: HIJSMM301A6MNM.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtcctcggtcagcccaaggctcgccccctcggtcactctcgttcccaccctcctcc

SEQ ID NO: 593885 - DNA, 522 bp, Homo sapiens; identical to SEQ ID NO: 543352
  misc_feature: HIJSMM301DF0IO.27.23.C01.1.454.light.4.raw

SEQ ID NO: 593886 - DNA, 503 bp, Homo sapiens; identical to SEQ ID NO: 555417
  misc_feature: HIJSMM301BICJU.18.11.A11.1.454.light.4.raw

SEQ ID NO: 593887 - DNA, 517 bp, Homo sapiens
  misc_feature: HIJSMM301CT8UU.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccaccctcctcc

SEQ ID NO: 593888 - DNA, 427 bp, Homo sapiens
  misc_feature: HIJSMM301D1WP0.41.35.D02.1.454.light.4.raw
tctatactatcacgaccggtgctcgatttagcacacgatagttgggtttgggggctcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtctaggtcagcccaaggctgccccctcggtcactctgttcccgccctcctcatagtataga

SEQ ID NO: 593889 - DNA, 499 bp, Homo sapiens; identical to SEQ ID NO: 571660
  misc_feature: HIJSMM301BSQBG.52.37.D04.1.454.light.4.raw

SEQ ID NO: 593890 - DNA, 494 bp, Homo sapiens
  misc_feature: HIJSMM301DUZS7.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctaccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 593891 - DNA, 502 bp, Homo sapiens; identical to SEQ ID NO: 540449
  misc_feature: HIJSMM301C9RLE.10.71.G05.1.454.light.4.raw

SEQ ID NO: 593892 - DNA, 478 bp, Homo sapiens; identical to SEQ ID NO: 543315
  misc_feature: HIJSMM301BVT1B.26.72.G06.1.454.light.4.raw

SEQ ID NO: 593893 - DNA, 471 bp, Homo sapiens
  misc_feature: HIJSMM301CTIRW.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgaacacgcag

SEQ ID NO: 593894 - DNA, 513 bp, Homo sapiens
  misc_feature: HIJSMM301DN8RS.52.16.B05.1.454.light.4.raw
cgcagtacgacacgaccggtgctcgatttagagctcacgtaaggggctgggcctaaggaagcagcactggtggtgcctcagccatggcctggaccgttctcctcctcggcctcctctctcactgcacagactatgtgacttcctatgtgctgactcagccaccctcggcgtcagtggccccaggacagacggccacgattacctgtgagggaaactacattgaaaggaaaagtgtccattggtatcagcagaagccaggccaggcccctgtgctggtcctccatgatgatagcgaccggccctcagggatccctgagggattctccggctccaactctgggaacacggccaccctgaccatcagcagggtcgaagccggagatgaggccgactattactgtcaggtgtgggatcgtgatagtgaccattgggtgttcggcggagggaccaagttgaccgtcctaagtcagcccaaggctgccccctcggtcactctgttcccaccctcctcta

SEQ ID NO: 593895 - DNA, 487 bp, Homo sapiens; identical to SEQ ID NO: 577099
  misc_feature: HIJSMM301A4D56.46.26.C04.1.454.light.4.raw

SEQ ID NO: 593896 - DNA, 486 bp, Homo sapiens; identical to SEQ ID NO: 535043
  misc_feature: HIJSMM301BEWCX.46.35.D02.1.454.light.4.raw

SEQ ID NO: 593897 - DNA, 504 bp, Homo sapiens
  misc_feature: HIJSMM301BA7XL.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacccctcaccatcaatagcctggaagctgaagatgctgcaacttattactgtcatcagagtactactttacctcaagtgatcaccttcggccaagggacacgactggagattaaacg

SEQ ID NO: 593898 - DNA, 476 bp, Homo sapiens
  misc_feature: HIJSMM301DB5B1.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaagggaagtaatgaagttaacactgtggatcaccttcggccaagggacacgactggagattaaacgaactgtggctgcaccatctgtcttcatcttcccgccatctgaagtatagtct

SEQ ID NO: 593899 - DNA, 497 bp, Homo sapiens; identical to SEQ ID NO: 536376
  misc_feature: HIJSMM301AZX1E.22.9.A09.1.454.light.4.raw

SEQ ID NO: 593900 - DNA, 504 bp, Homo sapiens
  misc_feature: HIJSMM301AX072.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaattttggtgttcggcggagggaccaagctgaccgtcctaggtcagcccaaggctgccccctcggtcta

SEQ ID NO: 593901 - DNA, 518 bp, Homo sapiens
  misc_feature: HIJSMM301CJSVG.22.36.D03.1.454.light.4.raw
acatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactcttccg

SEQ ID NO: 593902 - DNA, 514 bp, Homo sapiens
  misc_feature: HIJSMM301AI054.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggttggttcggcggagggaccaagactgaccgtcctgcgtcagcccaaggctgccccctcggtcact

SEQ ID NO: 593903 - DNA, 494 bp, Homo sapiens; identical to SEQ ID NO: 534992
  misc_feature: HIJSMM301DM40Y.9.1.A01.1.454.light.4.raw

SEQ ID NO: 593904 - DNA, 483 bp, Homo sapiens
  misc_feature: HIJSMM301BKWUU.41.34.D01.1.454.light.4.raw
tctatactatcacgaccggtgctcgatttagatcgtctgtgttgggtttggggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacc

SEQ ID NO: 593905 - DNA, 533 bp, Homo sapiens
  misc_feature: HIJSMM301AE3T9.51.25.C03.1.454.light.4.raw
cgatcgtatacacgaccggtgctcgatttagtagtgtagatttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataaatcgacagggtggaggctgaggatgttgggttttattactgcatgcaaggtaacacaactggccgtgggacgtcggtccgaacggaaccggaacggtaggaaagaacaaacgaaactaacgtaggtgtcgtcaccacactcgtcttcta

SEQ ID NO: 593906 - DNA, 503 bp, Homo sapiens; identical to SEQ ID NO: 551912
  misc_feature: HIJSMM301CWXM6.12.50.E06.1.454.light.4.raw

SEQ ID NO: 593907 - DNA, 521 bp, Homo sapiens; identical to SEQ ID NO: 539470
  misc_feature: HIJSMM301B514Y.27.23.C01.1.454.light.4.raw

SEQ ID NO: 593908 - DNA, 500 bp, Homo sapiens; identical to SEQ ID NO: 536183
  misc_feature: HIJSMM301EBZSV.10.17.B06.1.454.light.4.raw

SEQ ID NO: 593909 - DNA, 509 bp, Homo sapiens
  misc_feature: HIJSMM301CZRKM.51.37.D04.1.454.light.4.raw
cgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagcccaaggctgccccctcggtcactctgttccccg

SEQ ID NO: 593910 - DNA, 484 bp, Homo sapiens; identical to SEQ ID NO: 577957
  misc_feature: HIJSMM301CQRCL.49.57.F02.1.454.light.4.raw

SEQ ID NO: 593911 - DNA, 481 bp, Homo sapiens; identical to SEQ ID NO: 541494
  misc_feature: HIJSMM301B8QB1.51.76.G10.1.454.light.4.raw

SEQ ID NO: 593912 - DNA, 504 bp, Homo sapiens; identical to SEQ ID NO: 539099
  misc_feature: HIJSMM301EJH3Y.19.85.H08.1.454.light.4.raw

SEQ ID NO: 593913 - DNA, 494 bp, Homo sapiens; identical to SEQ ID NO: 534994
  misc_feature: HIJSMM301BF4O4.27.78.H01.1.454.light.4.raw

SEQ ID NO: 593914 - DNA, 494 bp, Homo sapiens; identical to SEQ ID NO: 534994
  misc_feature: HIJSMM301C2DSK.27.78.H01.1.454.light.4.raw

SEQ ID NO: 593915 - DNA, 460 bp, Homo sapiens; identical to SEQ ID NO: 536053
  misc_feature: HIJSMM301B94H6.22.28.C06.1.454.light.4.raw

SEQ ID NO: 593916 - DNA, 463 bp, Homo sapiens; identical to SEQ ID NO: 535062
  misc_feature: HIJSMM301D9CD1.11.73.G07.1.454.light.4.raw

SEQ ID NO: 593917 - DNA, 498 bp, Homo sapiens; identical to SEQ ID NO: 537020
  misc_feature: HIJSMM301C35JJ.26.26.C04.1.454.light.4.raw

SEQ ID NO: 593918 - DNA, 349 bp, Homo sapiens
  misc_feature: HIJSMM301CTQOA.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctatagtacgtga

SEQ ID NO: 593919 - DNA, 486 bp, Homo sapiens; identical to SEQ ID NO: 537144
  misc_feature: HIJSMM301E0S5I.46.35.D02.1.454.light.4.raw

SEQ ID NO: 593920 - DNA, 506 bp, Homo sapiens; identical to SEQ ID NO: 546231
  misc_feature: HIJSMM301BH99M.8.71.G05.1.454.light.4.raw

SEQ ID NO: 593921 - DNA, 512 bp, Homo sapiens
  misc_feature: HIJSMM301BVNEU.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccagggaccgacacgtagaaatagagacgaaactacgtggcgtgcgaccactactgtcttctactcttcccgt

SEQ ID NO: 593922 - DNA, 508 bp, Homo sapiens; identical to SEQ ID NO: 554667
  misc_feature: HIJSMM301COU0O.2.21.B10.1.454.light.4.raw

SEQ ID NO: 593923 - DNA, 490 bp, Homo sapiens; identical to SEQ ID NO: 535865
  misc_feature: HIJSMM301CYVH6.5.11.A11.1.454.light.4.raw

SEQ ID NO: 593924 - DNA, 512 bp, Homo sapiens
  misc_feature: HIJSMM301BDDRQ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggcctgccccctcggtcactctgttcccaccctcctcgctacgt

SEQ ID NO: 593925 - DNA, 486 bp, Homo sapiens
  misc_feature: HIJSMM301DT3NZ.48.27.C05.1.454.light.4.raw
agtatacatacacgaccggtgctcgatttagacgcgatcgaagggtttgggctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaag

SEQ ID NO: 593926 - DNA, 487 bp, Homo sapiens; identical to SEQ ID NO: 535583
  misc_feature: HIJSMM301B6BI1.22.73.G07.1.454.light.4.raw

SEQ ID NO: 593927 - DNA, 422 bp, Homo sapiens; identical to SEQ ID NO: 537797
  misc_feature: HIJSMM301AM3C6.9.34.D01.1.454.light.4.raw

SEQ ID NO: 593928 - DNA, 500 bp, Homo sapiens
  misc_feature: HIJSMM301DUH5Z.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacggttggggtttattactgcatgcaaggtctaacaaaccccgatcaccttcggccgagggacacgcctggagattaaacgaactgtggctgcaccat

SEQ ID NO: 593929 - DNA, 488 bp, Homo sapiens
  misc_feature: HIJSMM301CV4DU.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttatgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtccaagtaacttttggccgagggaccaagctggagatacaaacgaactgtggctgcaccat

SEQ ID NO: 593930 - DNA, 486 bp, Homo sapiens; identical to SEQ ID NO: 535385
  misc_feature: HIJSMM301DIS9B.19.71.G05.1.454.light.4.raw

SEQ ID NO: 593931 - DNA, 485 bp, Homo sapiens; identical to SEQ ID NO: 536799
  misc_feature: HIJSMM301BQ0G5.19.71.G05.1.454.light.4.raw

SEQ ID NO: 593932 - DNA, 501 bp, Homo sapiens
  misc_feature: HIJSMM301A9Z5J.40.53.E09.1.454.light.4.raw
tctagcgactcacgaccggtgctcgatttagagagagtgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttatgcaggcagtttcgctctcgaagtgttcggcggagggaccgagctgaccgtcctacgtcacgcccaacggctccg

SEQ ID NO: 593933 - DNA, 488 bp, Homo sapiens; identical to SEQ ID NO: 536861
  misc_feature: HIJSMM301EPSBM.12.88.H11.1.454.light.4.raw

SEQ ID NO: 593934 - DNA, 506 bp, Homo sapiens; identical to SEQ ID NO: 534969
  misc_feature: HIJSMM301ARDYG.18.37.D04.1.454.light.4.raw

SEQ ID NO: 593935 - DNA, 503 bp, Homo sapiens; identical to SEQ ID NO: 535044
  misc_feature: HIJSMM301CEQVF.19.78.H01.1.454.light.4.raw

SEQ ID NO: 593936 - DNA, 500 bp, Homo sapiens
  misc_feature: HIJSMM301AVW9H.10.68.G02.1.454.light.4.raw
catagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaaggctgccccctcggtcactc

SEQ ID NO: 593937 - DNA, 514 bp, Homo sapiens; identical to SEQ ID NO: 553243
  misc_feature: HIJSMM301ATJ3X.49.38.D05.1.454.light.4.raw

SEQ ID NO: 593938 - DNA, 485 bp, Homo sapiens; identical to SEQ ID NO: 540285
  misc_feature: HIJSMM301BKT78.46.26.C04.1.454.light.4.raw

SEQ ID NO: 593939 - DNA, 493 bp, Homo sapiens
  misc_feature: HIJSMM301BT9UO.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctatcttttctcttcggaactgggaccacggtcaccgtctaggtcagcccaaggccaaccca

SEQ ID NO: 593940 - DNA, 478 bp, Homo sapiens
  misc_feature: HIJSMM301EAF9O.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgcctacttttcgggcggggggtaccaagggtggacatcaaaacgaa

SEQ ID NO: 593941 - DNA, 487 bp, Homo sapiens
  misc_feature: HIJSMM301A70HL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgagggaccaaggcgagatcagacgaactgtggctgcaccatctgtcttcta

SEQ ID NO: 593942 - DNA, 505 bp, Homo sapiens; identical to SEQ ID NO: 542754
  misc_feature: HIJSMM301EBGOH.4.57.F02.1.454.light.4.raw

SEQ ID NO: 593943 - DNA, 503 bp, Homo sapiens
  misc_feature: HIJSMM301AU2GS.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggacacctcagcctccctgaccatcagtgggctccggtccgaggatgaggctgactattactgtgcatcacgggacgcaaacatgggatgacaatctgagcggttgggtgttcggcggagggaccaaactgaccgtctaggtcagcccaa

SEQ ID NO: 593944 - DNA, 508 bp, Homo sapiens
  misc_feature: HIJSMM301AMYE8.8.42.D09.1.454.light.4.raw
ctcgcgtgtccacgaccggtgctcgatttagacacatacgcagggaaagggggctggggtctcaggaggcagcgcactcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttccccg

SEQ ID NO: 593945 - DNA, 494 bp, Homo sapiens; identical to SEQ ID NO: 534992
  misc_feature: HIJSMM301AE94F.9.1.A01.1.454.light.4.raw

SEQ ID NO: 593946 - DNA, 502 bp, Homo sapiens
  misc_feature: HIJSMM301D7HZ1.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatatttttctatcctccgtggacgttggccaagggaccagggtggaaatcagacgaactgtggctgcaccatctgtctt

SEQ ID NO: 593947 - DNA, 496 bp, Homo sapiens; identical to SEQ ID NO: 537925
  misc_feature: HIJSMM301DM5NF.22.14.B03.1.454.light.4.raw

SEQ ID NO: 593948 - DNA, 512 bp, Homo sapiens
  misc_feature: HIJSMM301DBYBQ.9.43.D10.1.454.light.4.raw
tgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccgccctcctcacg

SEQ ID NO: 593949 - DNA, 473 bp, Homo sapiens; identical to SEQ ID NO: 563638
  misc_feature: HIJSMM301ENNLZ.13.76.G10.1.454.light.4.raw

SEQ ID NO: 593950 - DNA, 495 bp, Homo sapiens
  misc_feature: HIJSMM301B1KEO.10.79.H02.1.454.light.4.raw
catagtagtgcacgaccggtgctcgatttagtgtcacacgaagggaaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgt

SEQ ID NO: 593951 - DNA, 515 bp, Homo sapiens; identical to SEQ ID NO: 564475
  misc_feature: HIJSMM301CI8ZK.15.86.H09.1.454.light.4.raw

SEQ ID NO: 593952 - DNA, 496 bp, Homo sapiens
  misc_feature: HIJSMM301ADYCT.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatacaacgtaacg

SEQ ID NO: 593953 - DNA, 485 bp, Homo sapiens; identical to SEQ ID NO: 536075
  misc_feature: HIJSMM301B3H5B.17.21.B10.1.454.light.4.raw

SEQ ID NO: 593954 - DNA, 484 bp, Homo sapiens; identical to SEQ ID NO: 535400
  misc_feature: HIJSMM301D376A.46.26.C04.1.454.light.4.raw

SEQ ID NO: 593955 - DNA, 460 bp, Homo sapiens; identical to SEQ ID NO: 536053
  misc_feature: HIJSMM301B9I6I.22.28.C06.1.454.light.4.raw

SEQ ID NO: 593956 - DNA, 485 bp, Homo sapiens
  misc_feature: HIJSMM301BCCEN.49.70.G04.1.454.light.4.raw
agtcgagagacacgaccggtgctcgatttagtgtagtgtgaagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 593957 - DNA, 459 bp, Homo sapiens; identical to SEQ ID NO: 547319
  misc_feature: HIJSMM301D38U2.22.28.C06.1.454.light.4.raw

SEQ ID NO: 593958 - DNA, 383 bp, Homo sapiens
  misc_feature: HIJSMM301AH1IH.48.67.G01.1.454.light.4.raw
agtatacatacacgaccggtgctcgatttagagtatacatattgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 593959 - DNA, 509 bp, Homo sapiens
  misc_feature: HIJSMM301BMUFV.17.33.C11.1.454.light.4.raw
  modified_base (468)..(468): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtnttaagtcagcccaaggctgccccctggtcactctgttccca

SEQ ID NO: 593960 - DNA, 500 bp, Homo sapiens; identical to SEQ ID NO: 536183
  misc_feature: HIJSMM301A20EF.10.17.B06.1.454.light.4.raw

SEQ ID NO: 593961 - DNA, 499 bp, Homo sapiens
  misc_feature: HIJSMM301C495O.49.82.H05.1.454.light.4.raw
agtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcaccacggcctccctgaccgtctctgggctccaggcagaggatgaggctcattattattgttgctcatatgcaggcaacttcgcttttgtcttcggaactgggaccgaggtcaccgtcctgggtcagcccaaggccaaccccactgt

SEQ ID NO: 593962 - DNA, 454 bp, Homo sapiens; identical to SEQ ID NO: 534964
  misc_feature: HIJSMM301APXKL.19.86.H09.1.454.light.4.raw

SEQ ID NO: 593963 - DNA, 490 bp, Homo sapiens; identical to SEQ ID NO: 541141
  misc_feature: HIJSMM301CZ08O.47.38.D05.1.454.light.4.raw

SEQ ID NO: 593964 - DNA, 478 bp, Homo sapiens
  misc_feature: HIJSMM301AN9JK.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgtttccgccctcctcgagtagtaca

SEQ ID NO: 593965 - DNA, 526 bp, Homo sapiens
  misc_feature: HIJSMM301B487V.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcgacggacgacggaggagacgaacgaacagtaggtgtcgtcgaccactactcgtcgttctactacttcccgttccccgtacctactcgt

SEQ ID NO: 593966 - DNA, 485 bp, Homo sapiens; identical to SEQ ID NO: 536210
  misc_feature: HIJSMM301ADKSZ.43.54.E10.1.454.light.4.raw

SEQ ID NO: 593967 - DNA, 475 bp, Homo sapiens
  misc_feature: HIJSMM301CVXQW.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagatttgcaacttactattgtcaacaggctaacagtttccgctcaccttcgcgggggaccaaggtggagatcaaacgaactgtggctgcacc

SEQ ID NO: 593968 - DNA, 486 bp, Homo sapiens
  misc_feature: HIJSMM301A2ET2.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacaacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 593969 - DNA, 444 bp, Homo sapiens; identical to SEQ ID NO: 535027
  misc_feature: HIJSMM301DEHP0.8.73.G07.1.454.light.4.raw

SEQ ID NO: 593970 - DNA, 523 bp, Homo sapiens
  misc_feature: HIJSMM301ENGNM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaaggaccgaacggtaggaagtacgaaacgaacgtacgtggcgtgcaccactctgtcttctatcttcccgtcccactctgtat

SEQ ID NO: 593971 - DNA, 486 bp, Homo sapiens; identical to SEQ ID NO: 535043
  misc_feature: HIJSMM301ARJLD.46.35.D02.1.454.light.4.raw

SEQ ID NO: 593972 - DNA, 477 bp, Homo sapiens
  misc_feature: HIJSMM301CWGH7.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcagggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctcgttcccgccctcctcgatagtaca

SEQ ID NO: 593973 - DNA, 492 bp, Homo sapiens
  misc_feature: HIJSMM301C27GP.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatacagacgaactgtggctgcaccatctgtcttcta

SEQ ID NO: 593974 - DNA, 505 bp, Homo sapiens
  misc_feature: HIJSMM301EJU9A.48.23.C01.1.454.light.4.raw
agtatacatacacgaccggtgctcgatttagtacacgtgattagggattggggagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggaggaccaagttgaccgtctaggtcaaccaggctgccccctcggtcactctgttccc

SEQ ID NO: 593975 - DNA, 489 bp, Homo sapiens; identical to SEQ ID NO: 535386
  misc_feature: HIJSMM301B01NF.12.51.E07.1.454.light.4.raw

SEQ ID NO: 593976 - DNA, 508 bp, Homo sapiens; identical to SEQ ID NO: 556056
  misc_feature: HIJSMM301BS3GS.47.85.H08.1.454.light.4.raw

SEQ ID NO: 593977 - DNA, 511 bp, Homo sapiens
  misc_feature: HIJSMM301EV3O0.51.27.C05.1.454.light.4.raw
cgatcgtatacacgaccggtgctcgatttagacgcgatcgaagggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtaggaaatacaaacgaactagtggctgcaccatctgtcttcat

SEQ ID NO: 593978 - DNA, 506 bp, Homo sapiens; identical to SEQ ID NO: 554661
  misc_feature: HIJSMM301DAHFF.3.79.H02.1.454.light.4.raw

SEQ ID NO: 593979 - DNA, 486 bp, Homo sapiens; identical to SEQ ID NO: 535043
  misc_feature: HIJSMM301E2G0R.46.35.D02.1.454.light.4.raw

SEQ ID NO: 593980 - DNA, 504 bp, Homo sapiens
  misc_feature: HIJSMM301A15GL.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttccccgccctcctcg

SEQ ID NO: 593981 - DNA, 506 bp, Homo sapiens
  misc_feature: HIJSMM301CNV1C.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctcctgaccgtctctgggctccaggctgaggatgaggctgattattactgcagctcatatggagcagcgacaatttggtgttcggcggagggaccaagctgaccgtcctaggtcagcccaaggctgccccctggtccacgtctccgg

SEQ ID NO: 593982 - DNA, 497 bp, Homo sapiens
  misc_feature: HIJSMM301D8ZZH.2.49.E05.1.454.light.4.raw
acgctcgacacacgaccggtgctcgatttagagcgactagcaacacacaaaggggggggaaggctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtct

SEQ ID NO: 593983 - DNA, 513 bp, Homo sapiens
  misc_feature: HIJSMM301CJL54.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcagggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttccccg

SEQ ID NO: 593984 - DNA, 498 bp, Homo sapiens; identical to SEQ ID NO: 537020
  misc_feature: HIJSMM301C7UIO.26.26.C04.1.454.light.4.raw

SEQ ID NO: 593985 - DNA, 497 bp, Homo sapiens
  misc_feature: HIJSMM301A1KAU.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgcccctcggtcactctgttcccacctcctctgtcgagcgt

SEQ ID NO: 593986 - DNA, 494 bp, Homo sapiens; identical to SEQ ID NO: 581760
  misc_feature: HIJSMM301BRRZG.21.27.C05.1.454.light.4.raw
  modified_base (198)..(198): a, c, t, g, unknown or other

SEQ ID NO: 593987 - DNA, 512 bp, Homo sapiens
  misc_feature: HIJSMM301CJDYR.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccacctcctcgatagtaca

SEQ ID NO: 593988 - DNA, 498 bp, Homo sapiens; identical to SEQ ID NO: 553891
  misc_feature: HIJSMM301BUYAC.3.33.C11.1.454.light.4.raw

SEQ ID NO: 593989 - DNA, 495 bp, Homo sapiens; identical to SEQ ID NO: 588904
  misc_feature: HIJSMM301A9ZWN.11.81.H04.1.454.light.4.raw

SEQ ID NO: 593990 - DNA, 516 bp, Homo sapiens
  misc_feature: HIJSMM301CWO63.8.23.C01.1.454.light.4.raw
  modified_base (352)..(352): a, c, t, g, unknown or other
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacncggccaccctgaccatcagcaaagcccaagccggtgatgaggctgacttattttgtcaggtgtgggacagcagcatttatgtcttcggacctgggaccaaggtcaccgtcctaggtcagcccaaggcccaaccccactgtccactctgttcccacctcctcgaa

SEQ ID NO: 593991 - DNA, 444 bp, Homo sapiens; identical to SEQ ID NO: 535027
  misc_feature: HIJSMM301EZFXC.8.73.G07.1.454.light.4.raw

SEQ ID NO: 593992 - DNA, 494 bp, Homo sapiens
  misc_feature: HIJSMM301BFJTP.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcaggtcagcccaag

SEQ ID NO: 593993 - DNA, 505 bp, Homo sapiens; identical to SEQ ID NO: 538422
  misc_feature: HIJSMM301B0KJO.19.78.H01.1.454.light.4.raw

SEQ ID NO: 593994 - DNA, 500 bp, Homo sapiens; identical to SEQ ID NO: 546613
  misc_feature: HIJSMM301DOBIN.11.21.B10.1.454.light.4.raw

SEQ ID NO: 593995 - DNA, 489 bp, Homo sapiens; identical to SEQ ID NO: 548170
  misc_feature: HIJSMM301C2R03.48.25.C03.1.454.light.4.raw

SEQ ID NO: 593996 - DNA, 497 bp, Homo sapiens
  misc_feature: HIJSMM301BPJD0.17.25.C03.1.454.light.4.raw
cgtagactagcacgaccggtgctcgatttagtagtgtagatttgggtttgggggagtcgagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacaggatttcaattctcaccatcaccactctgcaacctgaggattgtgcaatctactactgtcaacagagttacagttcccctcgctacttttggcctaggggaccaaaggttgagatacaaacgaactgtaggctgcaccatctgtt

SEQ ID NO: 593997 - DNA, 484 bp, Homo sapiens; identical to SEQ ID NO: 535240
  misc_feature: HIJSMM301AYOB7.47.60.F05.1.454.light.4.raw

SEQ ID NO: 593998 - DNA, 493 bp, Homo sapiens
  misc_feature: HIJSMM301C0VKY.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcacttcggtcggagggaccgaaggcggagagtcagacgaactagtggctgcaccatctgtcttcta

SEQ ID NO: 593999 - DNA, 507 bp, Homo sapiens
  misc_feature: HIJSMM301EI6I0.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtccactctgtt

SEQ ID NO: 594000 - DNA, 505 bp, Homo sapiens
  misc_feature: HIJSMM301C0BY4.3.79.H02.1.454.light.4.raw
agacgcactccacgaccggtgctcgatttagtgtcacacgaagggaaagggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgctttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 594001 - DNA, 488 bp, Homo sapiens
  misc_feature: HIJSMM301DGCMH.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctcccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaactgt

SEQ ID NO: 594002 - DNA, 475 bp, Homo sapiens
  misc_feature: HIJSMM301B93YG.13.48.E04.1.454.light.4.raw
  modified_base (399)..(399): a, c, t, g, unknown or other
  modified_base (462)..(462): a, c, t, g, unknown or other
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgnaacttattactgtctacaagatcacaataatcctggacgtcgtcgacggacgaacgagaaganaacgaacaagtag

SEQ ID NO: 594003 - DNA, 479 bp, Homo sapiens
  misc_feature: HIJSMM301CE5LL.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtgggtcccaccaacgttcagcggcagtggatctgggacagaattcactctcaccatcagcagcctgcagcctgatgatgctgctaacttattactgtcaacaatataacagttattggacgttcggccaagggaccaaggtaggaaatcaaacgaactgtggctgcaccta

SEQ ID NO: 594004 - DNA, 494 bp, Homo sapiens; identical to SEQ ID NO: 545896
  misc_feature: HIJSMM301B9WDJ.13.6.A06.1.454.light.4.raw

SEQ ID NO: 594005 - DNA, 513 bp, Homo sapiens; identical to SEQ ID NO: 541387
  misc_feature: HIJSMM301DQW6I.17.33.C11.1.454.light.4.raw

SEQ ID NO: 594006 - DNA, 444 bp, Homo sapiens
  misc_feature: HIJSMM301DGX39.8.73.G07.1.454.light.4.raw
  modified_base (415)..(415): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcnctctgttcccaccctcctcgacacgcgag

SEQ ID NO: 594007 - DNA, 493 bp, Homo sapiens
  misc_feature: HIJSMM301D9EWN.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccaggggaccaagctggagatcaaacgaactgtggctgcacatctgtctt

SEQ ID NO: 594008 - DNA, 493 bp, Homo sapiens
  misc_feature: HIJSMM301BONIH.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtggcg

SEQ ID NO: 594009 - DNA, 499 bp, Homo sapiens
  misc_feature: HIJSMM301A22JF.9.21.B10.1.454.light.4.raw
tgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctc

SEQ ID NO: 594010 - DNA, 504 bp, Homo sapiens
  misc_feature: HIJSMM301AL6XE.48.30.C08.1.454.light.4.raw
agtatacatacacgaccggtgctcgatttagtctgacgtcaaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgtaactgtggctgcacc

SEQ ID NO: 594011 - DNA, 485 bp, Homo sapiens; identical to SEQ ID NO: 535985
  misc_feature: HIJSMM301AJ5YU.15.1.A01.1.454.light.4.raw

SEQ ID NO: 594012 - DNA, 485 bp, Homo sapiens
  misc_feature: HIJSMM301CPJOA.5.45.E01.1.454.light.4.raw
atcagacacgcacgaccggtgctcgatttagtgagtcagtaagggaaagggggcaggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaacgaactgtggctgcacc

SEQ ID NO: 594013 - DNA, 501 bp, Homo sapiens
  misc_feature: HIJSMM301DJXD8.4.37.D04.1.454.light.4.raw
agcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcagcccaaggccaa

SEQ ID NO: 594014 - DNA, 502 bp, Homo sapiens; identical to SEQ ID NO: 541971
  misc_feature: HIJSMM301C4MH8.4.39.D06.1.454.light.4.raw

SEQ ID NO: 594015 - DNA, 515 bp, Homo sapiens; identical to SEQ ID NO: 592944
  misc_feature: HIJSMM301DQNKG.15.57.F02.1.454.light.4.raw

SEQ ID NO: 594016 - DNA, 486 bp, Homo sapiens; identical to SEQ ID NO: 535043
  misc_feature: HIJSMM301ERXHU.46.35.D02.1.454.light.4.raw

SEQ ID NO: 594017 - DNA, 489 bp, Homo sapiens; identical to SEQ ID NO: 535139
  misc_feature: HIJSMM301BA7V3.14.55.E11.1.454.light.4.raw

SEQ ID NO: 594018 - DNA, 513 bp, Homo sapiens; identical to SEQ ID NO: 575973
  misc_feature: HIJSMM301D4OGH.43.23.C01.1.454.light.4.raw

SEQ ID NO: 594019 - DNA, 499 bp, Homo sapiens
  misc_feature: HIJSMM301BL8AJ.40.73.G07.1.454.light.4.raw
tctagcgactcacgaccggtgctcgatttagctctacgctcagggggaagagctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtattttgtcaacaacatgataagtcaccgttcagctttggccgggggacccaggtggagatcagacgaactgtggctgcaccatctgtcttcatcttccccg

SEQ ID NO: 594020 - DNA, 522 bp, Homo sapiens; identical to SEQ ID NO: 544405
  misc_feature: HIJSMM301BNJNJ.27.23.C01.1.454.light.4.raw

SEQ ID NO: 594021 - DNA, 473 bp, Homo sapiens; identical to SEQ ID NO: 559852
  misc_feature: HIJSMM301ATXU0.3.38.D05.1.454.light.4.raw

SEQ ID NO: 594022 - DNA, 480 bp, Homo sapiens; identical to SEQ ID NO: 535291
  misc_feature: HIJSMM301DOVJG.22.59.F04.1.454.light.4.raw

SEQ ID NO: 594023 - DNA, 495 bp, Homo sapiens; identical to SEQ ID NO: 536931
  misc_feature: HIJSMM301BM1OM.10.33.C11.1.454.light.4.raw

SEQ ID NO: 594024 - DNA, 460 bp, Homo sapiens; identical to SEQ ID NO: 537107
  misc_feature: HIJSMM301EIDSM.22.28.C06.1.454.light.4.raw

SEQ ID NO: 594025 - DNA, 485 bp, Homo sapiens
  misc_feature: HIJSMM301DXM5W.13.10.A10.1.454.light.4.raw
tcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaaggccggccagtcacctacattggttatctatgaagacacgaagcggccctcagggatccctgagcgattctctggctccaactctgggaacacagccactctgaccatcagcgggacccagcctatggatgaggctgactattactgtcaggcgtgggacagcagcactgcccgctatgtcttcggaactgggaccaaggtcaccgtcctaagtcagcccaaggccaaccca

SEQ ID NO: 594026 - DNA, 507 bp, Homo sapiens; identical to SEQ ID NO: 563344
  misc_feature: HIJSMM301DF28U.3.79.H02.1.454.light.4.raw

SEQ ID NO: 594027 - DNA, 422 bp, Homo sapiens; identical to SEQ ID NO: 447881
  misc_feature: HIJSMM301C0BGL.9.34.D01.1.454.light.4.raw

SEQ ID NO: 594028 - DNA, 511 bp, Homo sapiens
  misc_feature: HIJSMM301A676I.49.55.E11.1.454.light.4.raw
agtcgagagacacgaccggtgctcgatttagcactcgcacgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggtcgggaccaggctgaccgtcctgggtcagcccaaggctgccccctccggtcactctgttcccta

SEQ ID NO: 594029 - DNA, 383 bp, Homo sapiens; identical to SEQ ID NO: 447524
  misc_feature: HIJSMM301C4AB5.41.26.C04.1.454.light.4.raw

SEQ ID NO: 594030 - DNA, 519 bp, Homo sapiens
  misc_feature: HIJSMM301A1AEZ.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggcccaaccccactgtcactctcgttcccgccctcccg

SEQ ID NO: 594031 - DNA, 498 bp, Homo sapiens
  misc_feature: HIJSMM301DDS7N.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttatactgtcagcagcgtaacaattggccgatcaccttcggccaagggacacgactggagattaaacgaactgtggctgcaccatctgtcttcatcttccgccat

SEQ ID NO: 594032 - DNA, 493 bp, Homo sapiens
  misc_feature: HIJSMM301D55LK.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggccggagggaccaaggtggagatcaaacgaaa

SEQ ID NO: 594033 - DNA, 497 bp, Homo sapiens; identical to SEQ ID NO: 578089
  misc_feature: HIJSMM301BD2SR.40.57.F02.1.454.light.4.raw

SEQ ID NO: 594034 - DNA, 505 bp, Homo sapiens
  misc_feature: HIJSMM301CF4WU.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctggccatcactgggctccaggctgaggatgaggctgactattactgccagtcctatgacatgaggctgagtggttcgtatgtcttcggatctgggaccaaggtcaccgtcctaagtcagcccaaggccaaccct

SEQ ID NO: 594035 - DNA, 492 bp, Homo sapiens
  misc_feature: HIJSMM301AI758.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccgaacggcggagatcagacgaactgtggctgcaccatctgtcttcta

SEQ ID NO: 594036 - DNA, 494 bp, Homo sapiens; identical to SEQ ID NO: 535828
  misc_feature: HIJSMM301B3GRN.3.36.D03.1.454.light.4.raw

SEQ ID NO: 594037 - DNA, 502 bp, Homo sapiens; identical to SEQ ID NO: 541501
  misc_feature: HIJSMM301EZ2XK.17.27.C05.1.454.light.4.raw

SEQ ID NO: 594038 - DNA, 474 bp, Homo sapiens
  misc_feature: HIJSMM301BGZQ3.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgcctacgttttggcggggggaccaaggtggacatcaaacgaa

SEQ ID NO: 594039 - DNA, 493 bp, Homo sapiens; identical to SEQ ID NO: 568484
  misc_feature: HIJSMM301C3AFV.52.10.A10.1.454.light.4.raw

SEQ ID NO: 594040 - DNA, 447 bp, Homo sapiens; identical to SEQ ID NO: 549542
  misc_feature: HIJSMM301ENZB4.18.9.A09.1.454.light.4.raw

SEQ ID NO: 594041 - DNA, 454 bp, Homo sapiens; identical to SEQ ID NO: 535005
  misc_feature: HIJSMM301DKKBV.19.86.H09.1.454.light.4.raw

SEQ ID NO: 594042 - DNA, 499 bp, Homo sapiens
  misc_feature: HIJSMM301BADM6.13.76.G10.1.454.light.4.raw
tcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccatcc

SEQ ID NO: 594043 - DNA, 493 bp, Homo sapiens
  misc_feature: HIJSMM301BH4MY.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggtaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaagggcggagatcagacgaactgtggctgccaccatctgtcttcatt

SEQ ID NO: 594044 - DNA, 485 bp, Homo sapiens; identical to SEQ ID NO: 545289
  misc_feature: HIJSMM301BG0D2.19.71.G05.1.454.light.4.raw

SEQ ID NO: 594045 - DNA, 528 bp, Homo sapiens
  misc_feature: HIJSMM301AIDFY.43.27.C05.1.454.light.4.raw
tgtgagtagtcacgaccggtgctcgatttagacgcgatcgaagggtttggggagcttcagctgtggtagagaagacaggattcaggacaatctccagcatggccggcttccctctcctcctcaccctcctcactcactgtgcagggtcctgggcccagtctgtactgactcagccaccctcagcgtctgggacccccgggcagagggtcaccatctcttgttctgggacctactccaacatcggaagtaattatgtttactggtaccagcagctcccaggaacggcccccaaactcctcatctataggaataatcagcggccctcaggggtccctgaccgattctctggctccaagtctggcacctcagcctccctggccatccgtgggctccggtccgaggatgaggctgattattactgcaactcacttacaacgaccgacacttgcgtattcggcggcgggaccaagctgaccgtcctaggtcagcccaaggctgccccctcggtcactctgttcccaccctcct

SEQ ID NO: 594046 - DNA, 482 bp, Homo sapiens
  misc_feature: HIJSMM301C3HU8.49.81.H04.1.454.light.4.raw
agtcgagagacacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccacggtggagatcaacgaactgtggctgcacc

SEQ ID NO: 594047 - DNA, 443 bp, Homo sapiens
  misc_feature: HIJSMM301BH08N.5.9.A09.1.454.light.4.raw
  modified_base (425)..(425): a, c, t, g, unknown or other
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagccaaggctgccccctcggtcactctgttcccnccctcctccgtgtctgat

SEQ ID NO: 594048 - DNA, 508 bp, Homo sapiens; identical to SEQ ID NO: 571338
  misc_feature: HIJSMM301CXC1S.17.28.C06.1.454.light.4.raw

SEQ ID NO: 594049 - DNA, 499 bp, Homo sapiens
  misc_feature: HIJSMM301EK7YV.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaaccc

SEQ ID NO: 594050 - DNA, 490 bp, Homo sapiens; identical to SEQ ID NO: 542396
  misc_feature: HIJSMM301CU4TK.16.53.E09.1.454.light.4.raw

SEQ ID NO: 594051 - DNA, 496 bp, Homo sapiens; identical to SEQ ID NO: 536248
  misc_feature: HIJSMM301EOOG9.22.27.C05.1.454.light.4.raw

SEQ ID NO: 594052 - DNA, 499 bp, Homo sapiens
  misc_feature: HIJSMM301BWFNS.40.57.F02.1.454.light.4.raw
tctagcgactcacgaccggtgctcgatttagctcgatatagttgggtttggggggggtctcagggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctccg

SEQ ID NO: 594053 - DNA, 475 bp, Homo sapiens
  misc_feature: HIJSMM301D3Y2S.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcaacg

SEQ ID NO: 594054 - DNA, 478 bp, Homo sapiens; identical to SEQ ID NO: 544059
  misc_feature: HIJSMM301DPDU8.40.59.F04.1.454.light.4.raw

SEQ ID NO: 594055 - DNA, 493 bp, Homo sapiens
  misc_feature: HIJSMM301CS983.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgctaacttactactgtcaacagagttacacgtacccccctcacctttcggcggagggaccaaggcggagatcagacgaactgtggctgcaccatctgtcttcta

SEQ ID NO: 594056 - DNA, 467 bp, Homo sapiens; identical to SEQ ID NO: 535997
  misc_feature: HIJSMM301BU1QB.5.36.D03.1.454.light.4.raw

SEQ ID NO: 594057 - DNA, 497 bp, Homo sapiens; identical to SEQ ID NO: 536376
  misc_feature: HIJSMM301CZMUN.22.9.A09.1.454.light.4.raw

SEQ ID NO: 594058 - DNA, 511 bp, Homo sapiens; identical to SEQ ID NO: 539858
  misc_feature: HIJSMM301BBSA4.17.33.C11.1.454.light.4.raw

SEQ ID NO: 594059 - DNA, 496 bp, Homo sapiens
  misc_feature: HIJSMM301C2H6V.52.35.D02.1.454.light.4.raw
cgcagtacgacacgaccggtgctcgatttagcacacgatagttgggtttgggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 594060 - DNA, 492 bp, Homo sapiens; identical to SEQ ID NO: 535939
  misc_feature: HIJSMM301CZ4CN.13.5.A05.1.454.light.4.raw

SEQ ID NO: 594061 - DNA, 502 bp, Homo sapiens
  misc_feature: HIJSMM301AUCKP.48.27.C05.1.454.light.4.raw
agtatacatacacgaccggtgctcgatttagacgcgatcgaagggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 594062 - DNA, 501 bp, Homo sapiens
  misc_feature: HIJSMM301EN83P.3.4.A04.1.454.light.4.raw
agacgcactccacgaccggtgctcgatttagagtagtgatcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccaaggtggaaatcaaacgaactgtggctgcaccatctgtctt

SEQ ID NO: 594063 - DNA, 509 bp, Homo sapiens
  misc_feature: HIJSMM301E0M64.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaaactgaccgtcctaggtcagcccaaggctgccccctcggtcactctgttccccg

SEQ ID NO: 594064 - DNA, 516 bp, Homo sapiens
  misc_feature: HIJSMM301BSZI6.15.86.H09.1.454.light.4.raw
  modified_base (402)..(402): a, c, t, g, unknown or other
  modified_base (429)..(429): a, c, t, g, unknown or other
tctacgtagccacgaccggtgctcgatttagtgctatagacttggggtttggggggacttccctggtctccttctacctactgcccttcattttctccacaggtctctgtgctctgcctgtgctgactcagcccccgtctgcatctgccttgctgggagcctcccgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccanacaattgatggccaaggacggttgggngttcgggcggagggaccaaggctgacccgtcctaggtcagcccaaggctcgccccctggtcactctgttcccgccctctcgctacgt

SEQ ID NO: 594065 - DNA, 492 bp, Homo sapiens
  misc_feature: HIJSMM301ED0ZG.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggccgggggaccaagctggagatcaaacgaactgtggctgcaccatctgtcttc

SEQ ID NO: 594066 - DNA, 497 bp, Homo sapiens; identical to SEQ ID NO: 538030
  misc_feature: HIJSMM301AF7ZZ.40.23.C01.1.454.light.4.raw

SEQ ID NO: 594067 - DNA, 502 bp, Homo sapiens
  misc_feature: HIJSMM301AVCVH.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggagtatacaaacgaactagtggctgcaccactctgtcttc

SEQ ID NO: 594068 - DNA, 496 bp, Homo sapiens; identical to SEQ ID NO: 544791
  misc_feature: HIJSMM301CT0XW.7.59.F04.1.454.light.4.raw

SEQ ID NO: 594069 - DNA, 488 bp, Homo sapiens
  misc_feature: HIJSMM301B6PST.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgtggtattcggcggagggaccaagctgaccgtcctaggtcagaccccg

SEQ ID NO: 594070 - DNA, 512 bp, Homo sapiens
  misc_feature: HIJSMM301D8TV9.22.36.D03.1.454.light.4.raw
acatacgcgtcacgaccggtgctcgatttagctgcgtcacgagtctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtctcggtcagcccaaggctgccccctcggtcact

SEQ ID NO: 594071 - DNA, 509 bp, Homo sapiens; identical to SEQ ID NO: 559299
  misc_feature: HIJSMM301APUJH.17.28.C06.1.454.light.4.raw

SEQ ID NO: 594072 - DNA, 495 bp, Homo sapiens
  misc_feature: HIJSMM301A4PKM.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctattcttttctcttcggaactggggaccacggtcaccggtctaggtcagcccaaggcccaaccc

SEQ ID NO: 594073 - DNA, 495 bp, Homo sapiens; identical to SEQ ID NO: 588904
  misc_feature: HIJSMM301EVP9V.11.81.H04.1.454.light.4.raw

SEQ ID NO: 594074 - DNA, 481 bp, Homo sapiens
  misc_feature: HIJSMM301CXL1Q.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtccagaacttttggccagggaccaagctggagatcaacgaactgtggctgcaccat

SEQ ID NO: 594075 - DNA, 444 bp, Homo sapiens; identical to SEQ ID NO: 535594
  misc_feature: HIJSMM301A31LY.9.9.A09.1.454.light.4.raw

SEQ ID NO: 594076 - DNA, 507 bp, Homo sapiens; identical to SEQ ID NO: 581496
  misc_feature: HIJSMM301CWX41.18.37.D04.1.454.light.4.raw

SEQ ID NO: 594077 - DNA, 488 bp, Homo sapiens; identical to SEQ ID NO: 537260
  misc_feature: HIJSMM301CXT98.47.70.G04.1.454.light.4.raw

SEQ ID NO: 594078 - DNA, 512 bp, Homo sapiens
  misc_feature: HIJSMM301DTE7V.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccgcctcctcgagtagtaca

SEQ ID NO: 594079 - DNA, 494 bp, Homo sapiens; identical to SEQ ID NO: 534992
  misc_feature: HIJSMM301DLQXB.9.1.A01.1.454.light.4.raw

SEQ ID NO: 594080 - DNA, 486 bp, Homo sapiens; identical to SEQ ID NO: 535043
  misc_feature: HIJSMM301C9TQ8.46.35.D02.1.454.light.4.raw

SEQ ID NO: 594081 - DNA, 495 bp, Homo sapiens
  misc_feature: HIJSMM301DXJ30.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcactcccaggcagattcagtggcaggtgggtctgggacagacttcactctcaccatcagcagactggacgcctagaagtattttgcagtctattactgtcagcagtatggtcacgtccaagtaactttggccgaggggaccaagctggagatacaaacgaactgtggctgcacatctcg

SEQ ID NO: 594082 - DNA, 487 bp, Homo sapiens; identical to SEQ ID NO: 547557
  misc_feature: HIJSMM301EGPNT.7.75.G09.1.454.light.4.raw

SEQ ID NO: 594083 - DNA, 508 bp, Homo sapiens
  misc_feature: HIJSMM301DW56I.11.57.F02.1.454.light.4.raw
  modified_base (496)..(496): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccagggaccaaggtggaagtcaagcgaactgtggctgcaccatctgtcttnatcttcccgtcc

SEQ ID NO: 594084 - DNA, 494 bp, Homo sapiens
  misc_feature: HIJSMM301EF6HN.15.71.G05.1.454.light.4.raw
tctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctcttcactttcggcggagggaccaaggtggatatcaaacgaactgtggctgcacc

SEQ ID NO: 594085 - DNA, 506 bp, Homo sapiens
  misc_feature: HIJSMM301AZWT5.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctacctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacgacctccctgaccgtctctgggctccaggctgacgatgaggctgattattactgcagctcacatgcagtcagtaacaatttcgggtttcggcggagggaccaagctgaccgtcctaagtcagcccaaggctgccccctcggtcact

SEQ ID NO: 594086 - DNA, 483 bp, Homo sapiens
  misc_feature: HIJSMM301ATVAY.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggatatcagacgaa

SEQ ID NO: 594087 - DNA, 514 bp, Homo sapiens
  misc_feature: HIJSMM301B1TRU.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtccttatgtggggcgtggcatttgggtgttcggcggagggaccaaactgaccgtcctaggtcagcccaaggctgccccctcggtcactctcg

SEQ ID NO: 594088 - DNA, 495 bp, Homo sapiens; identical to SEQ ID NO: 535007
  misc_feature: HIJSMM301BXHQ8.22.5.A05.1.454.light.4.raw

SEQ ID NO: 594089 - DNA, 516 bp, Homo sapiens
  misc_feature: HIJSMM301CRUOQ.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccgggtccgaggatgaggctgattattactgtgcagcatgggatgacagcctgagtggtccttgggtgttcggcggagggaccaagctgaccgtcctaagtcagcccaaggcctgccccctcggtcactctgttcccacctcctcg

SEQ ID NO: 594090 - DNA, 508 bp, Homo sapiens; identical to SEQ ID NO: 541327
  misc_feature: HIJSMM301DT2GJ.47.85.H08.1.454.light.4.raw

SEQ ID NO: 594091 - DNA, 500 bp, Homo sapiens
  misc_feature: HIJSMM301BF7PO.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacaactgtggctgcaccatctgtcttcatcttccccg

SEQ ID NO: 594092 - DNA, 510 bp, Homo sapiens
  misc_feature: HIJSMM301BNW5D.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccggggaccgaccgtggaaagtcaaacgaactagtggctgcaccatctgtcttcta

SEQ ID NO: 594093 - DNA, 502 bp, Homo sapiens; identical to SEQ ID NO: 544444
  misc_feature: HIJSMM301A439Y.5.24.C02.1.454.light.4.raw

SEQ ID NO: 594094 - DNA, 510 bp, Homo sapiens
  misc_feature: HIJSMM301C5TV3.49.55.E11.1.454.light.4.raw
agtcgagagacacgaccggtgctcgatttagcactcgcacgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggtcgggaccaggctgaccgtcctgggtcagcccaaggctgccccctcggtcactctgttcccta

SEQ ID NO: 594095 - DNA, 519 bp, Homo sapiens
  misc_feature: HIJSMM301BG2M9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttccaccct

SEQ ID NO: 594096 - DNA, 505 bp, Homo sapiens
  misc_feature: HIJSMM301AKAB4.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggaggggaccaaggtggccgtcctaggtcagcccaaggctgccccctcggtcact

SEQ ID NO: 594097 - DNA, 492 bp, Homo sapiens
  misc_feature: HIJSMM301EI23C.52.83.H06.1.454.light.4.raw
cgcagtacgacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccacctgaccatcagcgggacccaggctttggatgaggctgactattactgtcaggcgtgggacaccatcactggagtaatattcggcggagggaccaggctgaccgtcctaggtcagcccaaggctgccccctcggtcac

SEQ ID NO: 594098 - DNA, 501 bp, Homo sapiens; identical to SEQ ID NO: 536867
  misc_feature: HIJSMM301AZ5N8.5.86.H09.1.454.light.4.raw

SEQ ID NO: 594099 - DNA, 495 bp, Homo sapiens
  misc_feature: HIJSMM301CVL2M.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgcttgctcttatgcaggcagtttcgctctcgaagtgttcggcggaggaccgagctgaccgtcctacgtcagcccaa

SEQ ID NO: 594100 - DNA, 466 bp, Homo sapiens; identical to SEQ ID NO: 535366
  misc_feature: HIJSMM301EF4MX.13.4.A04.1.454.light.4.raw

SEQ ID NO: 594101 - DNA, 486 bp, Homo sapiens
  misc_feature: HIJSMM301D3UWF.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctcgccccctcggtcactctgttcccgccctcctctacgtgagct

SEQ ID NO: 594102 - DNA, 488 bp, Homo sapiens; identical to SEQ ID NO: 535081
  misc_feature: HIJSMM301B306S.26.23.C01.1.454.light.4.raw

SEQ ID NO: 594103 - DNA, 445 bp, Homo sapiens; identical to SEQ ID NO: 582720
  misc_feature: HIJSMM301EIP5R.9.9.A09.1.454.light.4.raw

SEQ ID NO: 594104 - DNA, 508 bp, Homo sapiens; identical to SEQ ID NO: 554548
  misc_feature: HIJSMM301ARTZ8.17.87.H10.1.454.light.4.raw

SEQ ID NO: 594105 - DNA, 509 bp, Homo sapiens; identical to SEQ ID NO: 539359
  misc_feature: HIJSMM301AFPAU.47.85.H08.1.454.light.4.raw

SEQ ID NO: 594106 - DNA, 489 bp, Homo sapiens
  misc_feature: HIJSMM301DPKI9.52.83.H06.1.454.light.4.raw
cgcagtacgacacgaccggtgctcgatttagatcacgtgcgtcgcggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtcttcattccc

SEQ ID NO: 594107 - DNA, 517 bp, Homo sapiens
  misc_feature: HIJSMM301EJC1S.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactattctgtcaagtgtgggacaccaacacttgtgtcttcgggactgggaccgaggtcaccgtcctaagtcagcccagggccaaccccactgtcactctgttcccaccctcctcgacacg

SEQ ID NO: 594108 - DNA, 494 bp, Homo sapiens
  misc_feature: HIJSMM301AIP44.51.35.D02.1.454.light.4.raw
cgatcgtatacacgaccggtgctcgatttagcacacgatagttgggtttgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 594109 - DNA, 460 bp, Homo sapiens; identical to SEQ ID NO: 536053
  misc_feature: HIJSMM301CZ0VT.22.28.C06.1.454.light.4.raw

SEQ ID NO: 594110 - DNA, 481 bp, Homo sapiens; identical to SEQ ID NO: 535993
  misc_feature: HIJSMM301D2MUX.21.25.C03.1.454.light.4.raw

SEQ ID NO: 594111 - DNA, 492 bp, Homo sapiens; identical to SEQ ID NO: 536087
  misc_feature: HIJSMM301CPNQ3.10.17.B06.1.454.light.4.raw

SEQ ID NO: 594112 - DNA, 504 bp, Homo sapiens; identical to SEQ ID NO: 538940
  misc_feature: HIJSMM301B6YGJ.2.35.D02.1.454.light.4.raw

SEQ ID NO: 594113 - DNA, 511 bp, Homo sapiens
  misc_feature: HIJSMM301DOMLJ.12.71.G05.1.454.light.4.raw
atacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggagttatagcacttgggtgttcggcggcgggaccaaagtgaccgtcctaagtcagccaaggctgccccctcggtcactctgttccgcct

SEQ ID NO: 594114 - DNA, 506 bp, Homo sapiens; identical to SEQ ID NO: 544918
  misc_feature: HIJSMM301EJH85.8.1.A01.1.454.light.4.raw

SEQ ID NO: 594115 - DNA, 484 bp, Homo sapiens; identical to SEQ ID NO: 535211
  misc_feature: HIJSMM301E1GEC.47.46.E02.1.454.light.4.raw

SEQ ID NO: 594116 - DNA, 494 bp, Homo sapiens
  misc_feature: HIJSMM301CNQ05.43.82.H05.1.454.light.4.raw
tgtgagtagtcacgaccggtgctcgatttagtcgagctctctcgcggggagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcagccccg

SEQ ID NO: 594117 - DNA, 505 bp, Homo sapiens; identical to SEQ ID NO: 539292
  misc_feature: HIJSMM301BA9ZC.19.85.H08.1.454.light.4.raw

SEQ ID NO: 594118 - DNA, 510 bp, Homo sapiens; identical to SEQ ID NO: 553863
  misc_feature: HIJSMM301C4PSI.16.46.E02.1.454.light.4.raw

SEQ ID NO: 594119 - DNA, 493 bp, Homo sapiens; identical to SEQ ID NO: 535047
  misc_feature: HIJSMM301CJ1JZ.16.53.E09.1.454.light.4.raw

SEQ ID NO: 594120 - DNA, 513 bp, Homo sapiens
  misc_feature: HIJSMM301C2BED.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaatagtactactcctgtggttttcggcggagggaccaagctgaccgtcctaggtcagcccaaggctgccccctcggtcactctgttccccg

SEQ ID NO: 594121 - DNA, 493 bp, Homo sapiens
  misc_feature: HIJSMM301C9E1H.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagtattttgcagttttattactgtcagcagcgtagcaactggcctctcaccttcggcggagggaccaaggtggagatacaaacgaactgtggctgcaccatctgt

SEQ ID NO: 594122 - DNA, 506 bp, Homo sapiens; identical to SEQ ID NO: 539926
  misc_feature: HIJSMM301DEA7B.5.24.C02.1.454.light.4.raw

SEQ ID NO: 594123 - DNA, 496 bp, Homo sapiens; identical to SEQ ID NO: 572680
  misc_feature: HIJSMM301B7L58.48.31.C09.1.454.light.4.raw

SEQ ID NO: 594124 - DNA, 492 bp, Homo sapiens
  misc_feature: HIJSMM301ELI8D.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcacctttcggcggagggaccaaggcggagatcagacgaactgtggctgcaccatctgtcttctac

SEQ ID NO: 594125 - DNA, 520 bp, Homo sapiens
  misc_feature: HIJSMM301BXSJH.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgagggaccaggctgaccgtcctaggtcagcccaaggctgccccctcggtcactctgttcccgccct

SEQ ID NO: 594126 - DNA, 492 bp, Homo sapiens; identical to SEQ ID NO: 568059
  misc_feature: HIJSMM301EEEVG.16.68.G02.1.454.light.4.raw

SEQ ID NO: 594127 - DNA, 406 bp, Homo sapiens
  misc_feature: HIJSMM301BVJJS.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccagggccaggcccctctgatggtcatctatttcgatagcgaccggccctcaggaatccctgcgcgattctcggggtccaactctgggagcacggcccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctcctacagtgct

SEQ ID NO: 594128 - DNA, 520 bp, Homo sapiens
  misc_feature: HIJSMM301BGCOZ.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtcccgccct

SEQ ID NO: 594129 - DNA, 485 bp, Homo sapiens
  misc_feature: HIJSMM301EI8ZY.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctagaagattttgctagtttattactgtcagcagtatcatgactggccgctcaccttcggccaagggacacgactggagattaaacgaactgtggctgcacat

SEQ ID NO: 594130 - DNA, 504 bp, Homo sapiens; identical to SEQ ID NO: 554247
  misc_feature: HIJSMM301CYH1T.19.78.H01.1.454.light.4.raw

SEQ ID NO: 594131 - DNA, 504 bp, Homo sapiens; identical to SEQ ID NO: 535561
  misc_feature: HIJSMM301D435C.4.57.F02.1.454.light.4.raw

SEQ ID NO: 594132 - DNA, 490 bp, Homo sapiens
  misc_feature: HIJSMM301D56YU.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggccaagggaccaaggtaggaaatcaaacgaactgtggctgcaccat

SEQ ID NO: 594133 - DNA, 305 bp, Homo sapiens; identical to SEQ ID NO: 544328
  misc_feature: HIJSMM301DM0W4.49.19.B08.1.454.light.4.raw

SEQ ID NO: 594134 - DNA, 497 bp, Homo sapiens; identical to SEQ ID NO: 536371
  misc_feature: HIJSMM301AVDZJ.16.78.H01.1.454.light.4.raw

SEQ ID NO: 594135 - DNA, 496 bp, Homo sapiens; identical to SEQ ID NO: 551939
  misc_feature: HIJSMM301CYT45.19.71.G05.1.454.light.4.raw

SEQ ID NO: 594136 - DNA, 484 bp, Homo sapiens; identical to SEQ ID NO: 538094
  misc_feature: HIJSMM301BTP3H.3.10.A10.1.454.light.4.raw

SEQ ID NO: 594137 - DNA, 502 bp, Homo sapiens
  misc_feature: HIJSMM301AU573.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtctgggtcagcccaaggctgccccctcggt

SEQ ID NO: 594138 - DNA, 502 bp, Homo sapiens
  misc_feature: HIJSMM301EYBNQ.40.33.C11.1.454.light.4.raw
tctagcgactcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 594139 - DNA, 496 bp, Homo sapiens; identical to SEQ ID NO: 548177
  misc_feature: HIJSMM301B24PT.18.59.F04.1.454.light.4.raw

SEQ ID NO: 594140 - DNA, 353 bp, Homo sapiens; identical to SEQ ID NO: 536338
  misc_feature: HIJSMM301E0N69.3.11.A11.1.454.light.4.raw

SEQ ID NO: 594141 - DNA, 522 bp, Homo sapiens; identical to SEQ ID NO: 539966
  misc_feature: HIJSMM301DEG3Y.27.23.C01.1.454.light.4.raw

SEQ ID NO: 594142 - DNA, 488 bp, Homo sapiens
  misc_feature: HIJSMM301CO11N.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagatttgctagtttttactgtcagcagtatagtaactggcctccgtacacttttggccagggaccagctagaatcaacgactgtggctgcaccatctgtcttct

SEQ ID NO: 594143 - DNA, 484 bp, Homo sapiens; identical to SEQ ID NO: 535211
  misc_feature: HIJSMM301BB0RW.47.46.E02.1.454.light.4.raw

SEQ ID NO: 594144 - DNA, 489 bp, Homo sapiens
  misc_feature: HIJSMM301CO40Q.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctaagctcctgatctatggtgcatccactttggaaagtggggtccctcaaggttcagcggcagtggatctgggacagatttcactctcgccatcagcagcctgcagactgaagattttgcaacttattttgtcaacaggctaacactttccccctcactttcggcggtagggaccaaggtggagatcaagcgaactgtggctgcaccatctgtctt

SEQ ID NO: 594145 - DNA, 488 bp, Homo sapiens
  misc_feature: HIJSMM301E0JFZ.41.2.A02.1.454.light.4.raw
  modified_base (467)..(467): a, c, t, g, unknown or other
tctatactatcacgaccggtgctcgatttagactcatctacaggggagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccagggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcnccatctgtcttcatcttcccg

SEQ ID NO: 594146 - DNA, 514 bp, Homo sapiens
  misc_feature: HIJSMM301EF4PV.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccaggactgaggacgaggctgattattactgctgctcatatacaggggacagcattatttgggtgtttcggcggagggaccaagctgaccgtcctgcgtcagcccaaggctgccccctcggtccact

SEQ ID NO: 594147 - DNA, 454 bp, Homo sapiens; identical to SEQ ID NO: 535005
  misc_feature: HIJSMM301DEAI8.19.86.H09.1.454.light.4.raw

SEQ ID NO: 594148 - DNA, 495 bp, Homo sapiens
  misc_feature: HIJSMM301ELIVQ.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtctaggtcagcccaaggctgccccctcggtcactctgttcccaccctctccgagtgcgtct

SEQ ID NO: 594149 - DNA, 486 bp, Homo sapiens
  misc_feature: HIJSMM301AE744.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggcctgccccccg

SEQ ID NO: 594150 - DNA, 489 bp, Homo sapiens
  misc_feature: HIJSMM301A486S.21.46.E02.1.454.light.4.raw
tcgtcgctcgcacgaccggtgctcgatttagactcatctacagggaaagggggtgggtccaggaggcagaactctgggtgtctcaccatggcctggatccatctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgaccgtcctaggtcagcccaaggctgccccc

SEQ ID NO: 594151 - DNA, 515 bp, Homo sapiens
  misc_feature: HIJSMM301C0RG2.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagatttttaccctcaccatcaggggtctacagcctgaagattttgcgtacttactattgtcaacagagttaccttctcccccggacgttcggtccgaagggaccgaacggtaggaaagtacaagcgaactagtggctgcaccatactgtcttcactcttccccgt

SEQ ID NO: 594152 - DNA, 456 bp, Homo sapiens
  misc_feature: HIJSMM301A5YUV.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatggacagtgtgaacggtccggttttcggcggagggaccaagctgaccgtcctaagtcagcccaaggctgccccctcggtcactctgtttcccaccctcctccacgagagta

SEQ ID NO: 594153 - DNA, 447 bp, Homo sapiens; identical to SEQ ID NO: 535201
  misc_feature: HIJSMM301CIFOJ.18.9.A09.1.454.light.4.raw

SEQ ID NO: 594154 - DNA, 515 bp, Homo sapiens; identical to SEQ ID NO: 540368
  misc_feature: HIJSMM301ELJ2C.16.88.H11.1.454.light.4.raw

SEQ ID NO: 594155 - DNA, 501 bp, Homo sapiens
  misc_feature: HIJSMM301CD1VA.48.82.H05.1.454.light.4.raw
agtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctcc

SEQ ID NO: 594156 - DNA, 494 bp, Homo sapiens; identical to SEQ ID NO: 536463
  misc_feature: HIJSMM301C8JP4.22.57.F02.1.454.light.4.raw

SEQ ID NO: 594157 - DNA, 487 bp, Homo sapiens; identical to SEQ ID NO: 555321
  misc_feature: HIJSMM301DBUSY.19.71.G05.1.454.light.4.raw

SEQ ID NO: 594158 - DNA, 493 bp, Homo sapiens
  misc_feature: HIJSMM301DHDK6.4.22.B11.1.454.light.4.raw
agcactgtagcacgaccggtgctcgatttagacgacagctcaggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttgggtttatttctgcatgcaaggtacacactggccgtacacttttggccaggggaccaagctggagatacaacgaactgtggctgcaccatctgtctt

SEQ ID NO: 594159 - DNA, 489 bp, Homo sapiens
  misc_feature: HIJSMM301E32E3.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcaccttcggccaacgggacgacgactggagatgaaacgaactagtggctgcacca

SEQ ID NO: 594160 - DNA, 475 bp, Homo sapiens; identical to SEQ ID NO: 544617
  misc_feature: HIJSMM301CB3I0.13.76.G10.1.454.light.4.raw

SEQ ID NO: 594161 - DNA, 516 bp, Homo sapiens
  misc_feature: HIJSMM301AQNCB.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttacactgtcagcagtatgttacgtccccgtggacgttcggccaaggaccaaggtggcaatcaaccgaactgtggctgcaccatctgtcttcatcttccccg

SEQ ID NO: 594162 - DNA, 500 bp, Homo sapiens
  misc_feature: HIJSMM301BSZC8.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactatcgttcccaccctcctctgtcgagcgt

SEQ ID NO: 594163 - DNA, 483 bp, Homo sapiens
  misc_feature: HIJSMM301AVHAM.51.76.G10.1.454.light.4.raw
cgatcgtatacacgaccggtgctcgatttagtcactcatacaggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacc

SEQ ID NO: 594164 - DNA, 472 bp, Homo sapiens; identical to SEQ ID NO: 535992
  misc_feature: HIJSMM301A4147.11.76.G10.1.454.light.4.raw

SEQ ID NO: 594165 - DNA, 503 bp, Homo sapiens
  misc_feature: HIJSMM301CMYPV.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcaccgtctaggtcagcccaaggccaaccctctgtca

SEQ ID NO: 594166 - DNA, 482 bp, Homo sapiens; identical to SEQ ID NO: 535216
  misc_feature: HIJSMM301CKIMW.17.26.C04.1.454.light.4.raw

SEQ ID NO: 594167 - DNA, 481 bp, Homo sapiens; identical to SEQ ID NO: 577156
  misc_feature: HIJSMM301DJ7WP.5.39.D06.1.454.light.4.raw

SEQ ID NO: 594168 - DNA, 492 bp, Homo sapiens
  misc_feature: HIJSMM301DOVBF.43.55.E11.1.454.light.4.raw
  modified_base (460)..(460): a, c, t, g, unknown or other
  modified_base (473)..(473): a, c, t, g, unknown or other
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcgccaaggaccaacgtggaatanaaacgaactgtgntgcaccatctgtcttcatt

SEQ ID NO: 594169 - DNA, 485 bp, Homo sapiens
  misc_feature: HIJSMM301BI41J.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctccaccttcggccaagggacacgactggagattaaacgaactgtggctgcaccat

SEQ ID NO: 594170 - DNA, 490 bp, Homo sapiens
  misc_feature: HIJSMM301DA4J2.5.45.E01.1.454.light.4.raw
atcagacacgcacgaccggtgctcgatttagtgagtcagtaagggaaaggggggggcacttctccctctaacactctccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaaagttctaatgctttccgcgcacgtttggccaggggaccaaggtagagatcaaacgaactgtggctgcaccatctgtcttcatcttcccgccat

SEQ ID NO: 594171 - DNA, 495 bp, Homo sapiens
  misc_feature: HIJSMM301BJMQ9.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggcctcccaggctcctcatgtatggtgcatctaccagggccactggtgtcccagccaggttcaggtggcaggtgggtctgggacagagttctctctcatcatcagcagcctgcagtctgaagtattttgcggtttattactgtcagcagtataatcagtcggcctccgtggacgttcggccgaagggaccgaaggtaggaaatacgaaacgaactggtaggcgt

SEQ ID NO: 594172 - DNA, 460 bp, Homo sapiens; identical to SEQ ID NO: 539553
  misc_feature: HIJSMM301BVDLS.11.86.H09.1.454.light.4.raw

SEQ ID NO: 594173 - DNA, 493 bp, Homo sapiens
  misc_feature: HIJSMM301CL1J1.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaggatcaaacgaaa

SEQ ID NO: 594174 - DNA, 479 bp, Homo sapiens
  misc_feature: HIJSMM301AXJUD.7.83.H06.1.454.light.4.raw
  modified_base (417)..(417): a, c, t, g, unknown or other
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgagacgaggctgactattactgctcancatgggacagcagcctccgtggtgtggtgatcggcggagggaccaggctgaccgtcctaggt

SEQ ID NO: 594175 - DNA, 488 bp, Homo sapiens; identical to SEQ ID NO: 535081
  misc_feature: HIJSMM301DV6HT.26.23.C01.1.454.light.4.raw

SEQ ID NO: 594176 - DNA, 463 bp, Homo sapiens; identical to SEQ ID NO: 535062
  misc_feature: HIJSMM301DNP7N.11.73.G07.1.454.light.4.raw

SEQ ID NO: 594177 - DNA, 494 bp, Homo sapiens; identical to SEQ ID NO: 540110
  misc_feature: HIJSMM301B812B.51.71.G05.1.454.light.4.raw

SEQ ID NO: 594178 - DNA, 482 bp, Homo sapiens; identical to SEQ ID NO: 535216
  misc_feature: HIJSMM301A1GLL.17.26.C04.1.454.light.4.raw

SEQ ID NO: 594179 - DNA, 511 bp, Homo sapiens
  misc_feature: HIJSMM301EV0A8.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaacgtaggatatcaaacgaactagtggctgcaccatctgtcttcta

SEQ ID NO: 594180 - DNA, 508 bp, Homo sapiens; identical to SEQ ID NO: 561979
  misc_feature: HIJSMM301B1U5A.47.85.H08.1.454.light.4.raw

SEQ ID NO: 594181 - DNA, 503 bp, Homo sapiens; identical to SEQ ID NO: 558036
  misc_feature: HIJSMM301BHPNF.18.78.H01.1.454.light.4.raw

SEQ ID NO: 594182 - DNA, 490 bp, Homo sapiens; identical to SEQ ID NO: 574852
  misc_feature: HIJSMM301CCE18.14.55.E11.1.454.light.4.raw

SEQ ID NO: 594183 - DNA, 495 bp, Homo sapiens
  misc_feature: HIJSMM301CJPAN.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaagtcaccgtctgggtcagccaaggccaacccactcgtcacttc

SEQ ID NO: 594184 - DNA, 488 bp, Homo sapiens; identical to SEQ ID NO: 541987
  misc_feature: HIJSMM301EWL2Y.8.12.B01.1.454.light.4.raw

SEQ ID NO: 594185 - DNA, 506 bp, Homo sapiens
  misc_feature: HIJSMM301CN03W.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttctaagatattcggcggagggaccaggctgaccgtcctgagtcagcccaaggctgccccccg

SEQ ID NO: 594186 - DNA, 513 bp, Homo sapiens
  misc_feature: HIJSMM301B2KXT.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaaggctcgccccctcggtcactctcgttcccta

SEQ ID NO: 594187 - DNA, 475 bp, Homo sapiens; identical to SEQ ID NO: 578176
  misc_feature: HIJSMM301AY486.41.8.A08.1.454.light.4.raw

SEQ ID NO: 594188 - DNA, 509 bp, Homo sapiens
  misc_feature: HIJSMM301EMH1G.47.85.H08.1.454.light.4.raw
  modified_base (506)..(506): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactcngtt

SEQ ID NO: 594189 - DNA, 518 bp, Homo sapiens; identical to SEQ ID NO: 536231
  misc_feature: HIJSMM301D3F09.22.30.C08.1.454.light.4.raw

SEQ ID NO: 594190 - DNA, 497 bp, Homo sapiens; identical to SEQ ID NO: 535740
  misc_feature: HIJSMM301AHPWR.3.71.G05.1.454.light.4.raw

SEQ ID NO: 594191 - DNA, 510 bp, Homo sapiens
  misc_feature: HIJSMM301B83CE.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccctccagtatataatgaaagttaagagtgatggcagccacaccaagggggcgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgt

SEQ ID NO: 594192 - DNA, 516 bp, Homo sapiens
  misc_feature: HIJSMM301AG4HU.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgacgggaccgaacggtaggaaagtacgaaacgaaacgtaacgtaggcgtcgtcgacccactactcgttccg

SEQ ID NO: 594193 - DNA, 484 bp, Homo sapiens; identical to SEQ ID NO: 554992
  misc_feature: HIJSMM301DD9FO.46.26.C04.1.454.light.4.raw
  modified_base (433)..(433): a, c, t, g, unknown or other

SEQ ID NO: 594194 - DNA, 493 bp, Homo sapiens; identical to SEQ ID NO: 535657
  misc_feature: HIJSMM301BZUML.27.78.H01.1.454.light.4.raw

SEQ ID NO: 594195 - DNA, 501 bp, Homo sapiens
  misc_feature: HIJSMM301E162U.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 594196 - DNA, 493 bp, Homo sapiens; identical to SEQ ID NO: 544835
  misc_feature: HIJSMM301AOFVX.43.29.C07.1.454.light.4.raw

SEQ ID NO: 594197 - DNA, 492 bp, Homo sapiens; identical to SEQ ID NO: 535126
  misc_feature: HIJSMM301DMWX5.18.11.A11.1.454.light.4.raw

SEQ ID NO: 594198 - DNA, 487 bp, Homo sapiens; identical to SEQ ID NO: 537079
  misc_feature: HIJSMM301A4DXN.14.55.E11.1.454.light.4.raw

SEQ ID NO: 594199 - DNA, 494 bp, Homo sapiens; identical to SEQ ID NO: 535828
  misc_feature: HIJSMM301DJBZ7.3.36.D03.1.454.light.4.raw

SEQ ID NO: 594200 - DNA, 497 bp, Homo sapiens
  misc_feature: HIJSMM301ASVST.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcgagggggtattcggcggagggaccaagttgaccgtccttggtcagcccaaggctgccccctcggtcact

SEQ ID NO: 594201 - DNA, 508 bp, Homo sapiens
  misc_feature: HIJSMM301BPCGQ.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaagcggccctcaggggtccctgatcgcttctctggctccaagtctggcaacacggcctccctgacccgtctctgggctccagactgaggatgaggctgactattactgcagctcatttgcaggcagccgtatactcttcggcggagggaccaagctgaccgtcctaggtcagcccaaggctcgccccctcggtcacc

SEQ ID NO: 594202 - DNA, 504 bp, Homo sapiens; identical to SEQ ID NO: 570463
  misc_feature: HIJSMM301BQ2AI.21.22.B11.1.454.light.4.raw

SEQ ID NO: 594203 - DNA, 495 bp, Homo sapiens
  misc_feature: HIJSMM301B2DVI.22.14.B03.1.454.light.4.raw
  modified_base (443)..(443): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctnagacgttcggccaagggaccaaggtggaaatcaaacgaactgtggctgcacc

SEQ ID NO: 594204 - DNA, 490 bp, Homo sapiens
  misc_feature: HIJSMM301EIAH1.16.68.G02.1.454.light.4.raw
  modified_base (412)..(412): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacngtatcatcatcattgtaatttcggtggagggaccaaggtggaggtcaaagaactgtggctgcaccatctgtcttcatt

SEQ ID NO: 594205 - DNA, 511 bp, Homo sapiens
  misc_feature: HIJSMM301CKHF4.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctcgccccctc

SEQ ID NO: 594206 - DNA, 486 bp, Homo sapiens; identical to SEQ ID NO: 536261
  misc_feature: HIJSMM301AVH1Z.26.55.E11.1.454.light.4.raw

SEQ ID NO: 594207 - DNA, 505 bp, Homo sapiens; identical to SEQ ID NO: 536254
  misc_feature: HIJSMM301D2BT1.7.71.G05.1.454.light.4.raw

SEQ ID NO: 594208 - DNA, 485 bp, Homo sapiens; identical to SEQ ID NO: 556816
  misc_feature: HIJSMM301ES6BD.26.23.C01.1.454.light.4.raw

SEQ ID NO: 594209 - DNA, 492 bp, Homo sapiens; identical to SEQ ID NO: 573597
  misc_feature: HIJSMM301B457X.10.72.G06.1.454.light.4.raw

SEQ ID NO: 594210 - DNA, 383 bp, Homo sapiens; identical to SEQ ID NO: 447524
  misc_feature: HIJSMM301CQP34.41.26.C04.1.454.light.4.raw

SEQ ID NO: 594211 - DNA, 515 bp, Homo sapiens; identical to SEQ ID NO: 553540
  misc_feature: HIJSMM301CQI4U.22.36.D03.1.454.light.4.raw

SEQ ID NO: 594212 - DNA, 444 bp, Homo sapiens; identical to SEQ ID NO: 536685
  misc_feature: HIJSMM301CDG93.10.76.G10.1.454.light.4.raw

SEQ ID NO: 594213 - DNA, 506 bp, Homo sapiens; identical to SEQ ID NO: 592600
  misc_feature: HIJSMM301AZX9D.2.71.G05.1.454.light.4.raw

SEQ ID NO: 594214 - DNA, 511 bp, Homo sapiens
  misc_feature: HIJSMM301CEMRF.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccacctgtcactctgttcccaccctcctccgtgtctgat

SEQ ID NO: 594215 - DNA, 513 bp, Homo sapiens
  misc_feature: HIJSMM301D37L5.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgtaga

SEQ ID NO: 594216 - DNA, 518 bp, Homo sapiens; identical to SEQ ID NO: 547137
  misc_feature: HIJSMM301DTHEN.8.87.H10.1.454.light.4.raw

SEQ ID NO: 594217 - DNA, 504 bp, Homo sapiens
  misc_feature: HIJSMM301BE26J.51.37.D04.1.454.light.4.raw
cgatcgtatacacgaccggtgctcgatttagtagcatactgttgggtttggggtgtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagcccaaggctgccccctcggtcactctcg

SEQ ID NO: 594218 - DNA, 483 bp, Homo sapiens
  misc_feature: HIJSMM301A2MWC.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcagggtccctgaccgattctctggctccaagtctggcacctcagcctccctggtcatcgctgggctccaggctgacgatgaggctgattattattgcagtcctatgacaacacctcgcgttggttttggtctgttcggtcggcgggaccg

SEQ ID NO: 594219 - DNA, 521 bp, Homo sapiens; identical to SEQ ID NO: 538715
  misc_feature: HIJSMM301AQR07.27.23.C01.1.454.light.4.raw

SEQ ID NO: 594220 - DNA, 453 bp, Homo sapiens
  misc_feature: HIJSMM301CWCCO.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctggtcactctgttcccaccctcctccacgagagta

SEQ ID NO: 594221 - DNA, 504 bp, Homo sapiens
  misc_feature: HIJSMM301DNJ02.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatggaggggtgcagagaactccatggctaccaggtcagcccaaggccaaccccactgtcactctgttcccaccctcctcta

SEQ ID NO: 594222 - DNA, 493 bp, Homo sapiens
  misc_feature: HIJSMM301CPLB8.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctcgtcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagtcagcgtagcaactggcctctcactttcggcgagggaccagggtggagatcaggacgaacgtgtggctgcaccatctgt

SEQ ID NO: 594223 - DNA, 505 bp, Homo sapiens
  misc_feature: HIJSMM301BN7QY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaatcaaacgaactagtggctgcaccatctgtcttcactcttccccg

SEQ ID NO: 594224 - DNA, 491 bp, Homo sapiens; identical to SEQ ID NO: 538021
  misc_feature: HIJSMM301B1C3U.3.72.G06.1.454.light.4.raw

SEQ ID NO: 594225 - DNA, 490 bp, Homo sapiens
  misc_feature: HIJSMM301CDS5T.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccagggaccagctagaaatcaaacgaactgtgctgcacatctgtcttca

SEQ ID NO: 594226 - DNA, 494 bp, Homo sapiens; identical to SEQ ID NO: 534992
  misc_feature: HIJSMM301DUPP9.9.1.A01.1.454.light.4.raw

SEQ ID NO: 594227 - DNA, 504 bp, Homo sapiens; identical to SEQ ID NO: 550923
  misc_feature: HIJSMM301DXREY.51.2.A02.1.454.light.4.raw

SEQ ID NO: 594228 - DNA, 507 bp, Homo sapiens
  misc_feature: HIJSMM301B6HQV.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactaggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 594229 - DNA, 517 bp, Homo sapiens
  misc_feature: HIJSMM301ENKHC.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactcctgttccccaccctcct

SEQ ID NO: 594230 - DNA, 494 bp, Homo sapiens; identical to SEQ ID NO: 534992
  misc_feature: HIJSMM301EBUFO.9.1.A01.1.454.light.4.raw

SEQ ID NO: 594231 - DNA, 489 bp, Homo sapiens; identical to SEQ ID NO: 542780
  misc_feature: HIJSMM301CNRN8.16.53.E09.1.454.light.4.raw

SEQ ID NO: 594232 - DNA, 483 bp, Homo sapiens; identical to SEQ ID NO: 579713
  misc_feature: HIJSMM301B43M2.4.6.A06.1.454.light.4.raw

SEQ ID NO: 594233 - DNA, 507 bp, Homo sapiens
  misc_feature: HIJSMM301CPKJ1.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaattggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgt

SEQ ID NO: 594234 - DNA, 460 bp, Homo sapiens; identical to SEQ ID NO: 537107
  misc_feature: HIJSMM301ER5OA.22.28.C06.1.454.light.4.raw

SEQ ID NO: 594235 - DNA, 494 bp, Homo sapiens
  misc_feature: HIJSMM301B15FS.9.1.A01.1.454.light.4.raw
  modified_base (466)..(466): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctacaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagattaaaggaactgnggctgcaccatctgtcttcatcttcccg

SEQ ID NO: 594236 - DNA, 454 bp, Homo sapiens
  misc_feature: HIJSMM301DS0WR.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccaccctcctcgtatctctcg

SEQ ID NO: 594237 - DNA, 504 bp, Homo sapiens
  misc_feature: HIJSMM301C8NMR.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagccaaggctgccccctcggt

SEQ ID NO: 594238 - DNA, 493 bp, Homo sapiens
  misc_feature: HIJSMM301D8C8G.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttctgctccgtacacttttggccaggggacccaggtggagatcagacgaactgtggctgcaccatctgtcttcatcttcccg

SEQ ID NO: 594239 - DNA, 486 bp, Homo sapiens; identical to SEQ ID NO: 535385
  misc_feature: HIJSMM301A83JM.19.71.G05.1.454.light.4.raw

SEQ ID NO: 594240 - DNA, 502 bp, Homo sapiens; identical to SEQ ID NO: 541501
  misc_feature: HIJSMM301CNXW6.17.27.C05.1.454.light.4.raw

SEQ ID NO: 594241 - DNA, 506 bp, Homo sapiens
  misc_feature: HIJSMM301B222F.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccactgt

SEQ ID NO: 594242 - DNA, 485 bp, Homo sapiens
  misc_feature: HIJSMM301CO9OA.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttatttactgtatgcaaggtatagagcttcctccgacgttcggccaagggaccaaggtggaactcaaacgaactgtggctgcaccatctgtcttcatcttcccgccatctgactagtctacg

SEQ ID NO: 594243 - DNA, 511 bp, Homo sapiens; identical to SEQ ID NO: 537464
  misc_feature: HIJSMM301EAQYC.7.34.D01.1.454.light.4.raw

SEQ ID NO: 594244 - DNA, 486 bp, Homo sapiens; identical to SEQ ID NO: 539294
  misc_feature: HIJSMM301EMS7Y.12.33.C11.1.454.light.4.raw

SEQ ID NO: 594245 - DNA, 505 bp, Homo sapiens
  misc_feature: HIJSMM301DSYMT.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaacgggacacgactggagattaaaacg

SEQ ID NO: 594246 - DNA, 520 bp, Homo sapiens; identical to SEQ ID NO: 539176
  misc_feature: HIJSMM301A3KDR.27.23.C01.1.454.light.4.raw

SEQ ID NO: 594247 - DNA, 486 bp, Homo sapiens
  misc_feature: HIJSMM301ENIKT.46.35.D02.1.454.light.4.raw
  modified_base (197)..(197): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagngccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 594248 - DNA, 470 bp, Homo sapiens
  misc_feature: HIJSMM301EX3IX.13.39.D06.1.454.light.4.raw
tcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcct

SEQ ID NO: 594249 - DNA, 506 bp, Homo sapiens
  misc_feature: HIJSMM301C195O.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggtcggagggaccaagctgaccgtcctgggtcagcccaacggctgccccctcggtcta

SEQ ID NO: 594250 - DNA, 515 bp, Homo sapiens
  misc_feature: HIJSMM301BIIZ0.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctagccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccactttcggcccgtcgggaccgaacggtggagatcaaacgaaacgtgtggctgcaccatctgtcttcta

SEQ ID NO: 594251 - DNA, 471 bp, Homo sapiens
  misc_feature: HIJSMM301DIBGM.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggtagatcaagcgaa

SEQ ID NO: 594252 - DNA, 498 bp, Homo sapiens
  misc_feature: HIJSMM301C3CQ7.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatggtggcagtttattattgtcagcaatattatattcctcctcagacgttcggccaagggaccaaggtggaaatcaaaacgaactgtggctgcacc

SEQ ID NO: 594253 - DNA, 497 bp, Homo sapiens; identical to SEQ ID NO: 535286
  misc_feature: HIJSMM301BI3NI.18.59.F04.1.454.light.4.raw

SEQ ID NO: 594254 - DNA, 494 bp, Homo sapiens; identical to SEQ ID NO: 567170
  misc_feature: HIJSMM301A083N.22.57.F02.1.454.light.4.raw

SEQ ID NO: 594255 - DNA, 486 bp, Homo sapiens; identical to SEQ ID NO: 554021
  misc_feature: HIJSMM301DHDV7.40.83.H06.1.454.light.4.raw

SEQ ID NO: 594256 - DNA, 496 bp, Homo sapiens; identical to SEQ ID NO: 539888
  misc_feature: HIJSMM301D4OS6.15.58.F03.1.454.light.4.raw

SEQ ID NO: 594257 - DNA, 496 bp, Homo sapiens; identical to SEQ ID NO: 535541
  misc_feature: HIJSMM301BJPAZ.3.33.C11.1.454.light.4.raw

SEQ ID NO: 594258 - DNA, 492 bp, Homo sapiens; identical to SEQ ID NO: 535126
  misc_feature: HIJSMM301AVA95.18.11.A11.1.454.light.4.raw

SEQ ID NO: 594259 - DNA, 500 bp, Homo sapiens
  misc_feature: HIJSMM301EQ08Z.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaggtggaaatcaaacgaactgtggctgcacca

SEQ ID NO: 594260 - DNA, 447 bp, Homo sapiens; identical to SEQ ID NO: 535201
  misc_feature: HIJSMM301E1LDT.18.9.A09.1.454.light.4.raw

SEQ ID NO: 594261 - DNA, 515 bp, Homo sapiens
  misc_feature: HIJSMM301B7FAO.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacacttgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttccccg

SEQ ID NO: 594262 - DNA, 519 bp, Homo sapiens; identical to SEQ ID NO: 585672
  misc_feature: HIJSMM301CMUH4.22.30.C08.1.454.light.4.raw

SEQ ID NO: 594263 - DNA, 495 bp, Homo sapiens
  misc_feature: HIJSMM301CEOJK.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctcatcttcccgcatctgac

SEQ ID NO: 594264 - DNA, 516 bp, Homo sapiens
  misc_feature: HIJSMM301CVSOM.40.33.C11.1.454.light.4.raw
tctagcgactcacgaccggtgctcgatttagagtgagctcgttgggtttgggggtaaagggaccctcgaggaaaacaaaaccccacgctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 594265 - DNA, 492 bp, Homo sapiens
  misc_feature: HIJSMM301D00VL.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgattgcttctctggctccaagtctggcaacatggcctccctgaccatctctgggctccaggctgaggatgaggctgattactactgctgctcctttgcaggcgcctctgtctcaggcagctatgtcttcggaactgggaccaagtgaccgtctgggtcag

SEQ ID NO: 594266 - DNA, 486 bp, Homo sapiens; identical to SEQ ID NO: 536323
  misc_feature: HIJSMM301DZC94.10.2.A02.1.454.light.4.raw

SEQ ID NO: 594267 - DNA, 486 bp, Homo sapiens; identical to SEQ ID NO: 537310
  misc_feature: HIJSMM301E0P5A.15.28.C06.1.454.light.4.raw

SEQ ID NO: 594268 - DNA, 501 bp, Homo sapiens; identical to SEQ ID NO: 536142
  misc_feature: HIJSMM301EYLK5.15.1.A01.1.454.light.4.raw

SEQ ID NO: 594269 - DNA, 506 bp, Homo sapiens
  misc_feature: HIJSMM301BQRYJ.40.34.D01.1.454.light.4.raw
tctagcgactcacgaccggtgctcgatttagatcgtctgtgttgggtttggggggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtcctaggtcagcccaaggctcgccccctcggt

SEQ ID NO: 594270 - DNA, 503 bp, Homo sapiens; identical to SEQ ID NO: 538884
  misc_feature: HIJSMM301ELSCV.27.78.H01.1.454.light.4.raw

SEQ ID NO: 594271 - DNA, 463 bp, Homo sapiens; identical to SEQ ID NO: 535062
  misc_feature: HIJSMM301C3M0N.11.73.G07.1.454.light.4.raw

SEQ ID NO: 594272 - DNA, 485 bp, Homo sapiens; identical to SEQ ID NO: 536263
  misc_feature: HIJSMM301C6HI6.47.78.H01.1.454.light.4.raw

SEQ ID NO: 594273 - DNA, 493 bp, Homo sapiens; identical to SEQ ID NO: 536246
  misc_feature: HIJSMM301AQLDH.49.66.F11.1.454.light.4.raw

SEQ ID NO: 594274 - DNA, 508 bp, Homo sapiens
  misc_feature: HIJSMM301AWOTG.41.56.F01.1.454.light.4.raw
tctatactatcacgaccggtgctcgatttagcagacgtctgaacacacaaagggggggtcacaagaggcagcgctctcgggacgtctccaccatggcctgggctctgctgctcctcactctcctcactcaggacacagggtcctgggcccagtctgccctgactcagcctgactccgtgtctgggtctcctggacagtcgatcaccatctcctgcactggaaccaacagtgatgttgggaattataaccttgtctcctggtaccaacaccacccaggcaaagcccccaaactcataatttatgagggcagtaagcggccctcaggggtttctaatcgcttctctggctccaagtctggcaacacggcctccctgacaatctctggactccaggctgaggacgaggctgattattactgctgctcatatgcaggtagtagggattgggtgttcggcggagggaccaagctgaccgtcctgggtcagcccaaggctgccccctggtctac

SEQ ID NO: 594275 - DNA, 513 bp, Homo sapiens; identical to SEQ ID NO: 535719
  misc_feature: HIJSMM301EM0X3.17.33.C11.1.454.light.4.raw

SEQ ID NO: 594276 - DNA, 496 bp, Homo sapiens
  misc_feature: HIJSMM301D8UT5.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcggaccaaggtcacccgtcctggggtcagccccaaggccaaccccactgtcact

SEQ ID NO: 594277 - DNA, 512 bp, Homo sapiens
  misc_feature: HIJSMM301A75NH.52.77.G11.1.454.light.4.raw
cgcagtacgacacgaccggtgctcgatttagctagtcactcaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagcccaaggctgccccctcggtcactctcg

SEQ ID NO: 594278 - DNA, 488 bp, Homo sapiens; identical to SEQ ID NO: 538811
  misc_feature: HIJSMM301BV2SY.40.83.H06.1.454.light.4.raw

SEQ ID NO: 594279 - DNA, 503 bp, Homo sapiens
  misc_feature: HIJSMM301DTR4P.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtctaggtcagcccaaggccaacccactgtca

SEQ ID NO: 594280 - DNA, 503 bp, Homo sapiens; identical to SEQ ID NO: 538884
  misc_feature: HIJSMM301ANJ2Z.27.78.H01.1.454.light.4.raw

SEQ ID NO: 594281 - DNA, 501 bp, Homo sapiens
  misc_feature: HIJSMM301BBHMD.48.70.G04.1.454.light.4.raw
agtatacatacacgaccggtgctcgatttagtgtagtgtgaagggaaaggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 594282 - DNA, 517 bp, Homo sapiens
  misc_feature: HIJSMM301B2YO0.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtggttcggcggagggaccaagctgaccgtcctaggtcagcccaaggctgccccctcggtcactctgttcccgccctcctcgctacgtagac

SEQ ID NO: 594283 - DNA, 478 bp, Homo sapiens
  misc_feature: HIJSMM301BKFKZ.5.34.D01.1.454.light.4.raw
atcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctcgacctcgcaggacacgactggagattaaagaactagtggctgcacca

SEQ ID NO: 594284 - DNA, 486 bp, Homo sapiens
  misc_feature: HIJSMM301AOOE1.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccact

SEQ ID NO: 594285 - DNA, 446 bp, Homo sapiens; identical to SEQ ID NO: 537330
  misc_feature: HIJSMM301B7WZ5.18.9.A09.1.454.light.4.raw

SEQ ID NO: 594286 - DNA, 497 bp, Homo sapiens
  misc_feature: HIJSMM301DP7WC.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatacaaacgaactgtggctgcacatctgtcttcattcc

SEQ ID NO: 594287 - DNA, 495 bp, Homo sapiens
  misc_feature: HIJSMM301CUQYG.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcgaggggtccctgaccgattctccggctccaagtctggcacatcagcctccctggccatcactgggctccaggctgaggatgaggctgactattactgccagtcgtatgacagtggacctaagtaacatcgtcttcggaactgggaccaaggtcaccgtccg

SEQ ID NO: 594288 - DNA, 498 bp, Homo sapiens
  misc_feature: HIJSMM301EUCR4.51.25.C03.1.454.light.4.raw
cgatcgtatacacgaccggtgctcgatttagtagtgtagatttgggtttggggcagtctcagtcgggacacagcatggacatgagggtccccgctcagctcctggggctcctgctactctggctccgaggtgccagatgtgacatccagatgacccagtctccatcctccctgtctgcatctataggagacagagtcacaatcccttgccggtcaagtcaaaacattagcaactatttaaattggtatcaacagaaaccagggaaagcccctaacctcctgatctatgctgcttccactttgcaaagtggggtcccatcgaggttcagtggcagtggatctgggacagatttcagtctcaccatcaccaatctgcgacctgaagattttgcaacttattattgtcaacaggcttacatcacccctctcactttcggcggaggaccgaagtggagatcaaacgaaactgtggctgcaccatctgtcttcactcttcccg

SEQ ID NO: 594289 - DNA, 509 bp, Homo sapiens; identical to SEQ ID NO: 540180
  misc_feature: HIJSMM301EBVK4.5.60.F05.1.454.light.4.raw

SEQ ID NO: 594290 - DNA, 516 bp, Homo sapiens
  misc_feature: HIJSMM301ECA8O.40.12.B01.1.454.light.4.raw
tctagcgactcacgaccggtgctcgatttagtagtgtagattccgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtccactctcgttcccg

SEQ ID NO: 594291 - DNA, 524 bp, Homo sapiens
  misc_feature: HIJSMM301EO6CI.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtttactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttccccg

SEQ ID NO: 594292 - DNA, 486 bp, Homo sapiens; identical to SEQ ID NO: 535043
  misc_feature: HIJSMM301E3E93.46.35.D02.1.454.light.4.raw

SEQ ID NO: 594293 - DNA, 489 bp, Homo sapiens; identical to SEQ ID NO: 535139
  misc_feature: HIJSMM301C5UZ2.14.55.E11.1.454.light.4.raw

SEQ ID NO: 594294 - DNA, 498 bp, Homo sapiens
  misc_feature: HIJSMM301DQ5DT.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcgggcggagggaccaaggtgaccgtcctaggtcagcccaaggctg

SEQ ID NO: 594295 - DNA, 507 bp, Homo sapiens
  misc_feature: HIJSMM301D62RS.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaggtctccgtcctacgtcagcccaaggccaacccactgtcactctgttcccg

SEQ ID NO: 594296 - DNA, 496 bp, Homo sapiens
  misc_feature: HIJSMM301C5IW6.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgtattttcggcggagggaccaagctgaccgtcctgagtcagcccaaggctcg

SEQ ID NO: 594297 - DNA, 486 bp, Homo sapiens; identical to SEQ ID NO: 535458
  misc_feature: HIJSMM301ELH4C.7.75.G09.1.454.light.4.raw

SEQ ID NO: 594298 - DNA, 494 bp, Homo sapiens; identical to SEQ ID NO: 535276
  misc_feature: HIJSMM301EANPP.16.6.A06.1.454.light.4.raw

SEQ ID NO: 594299 - DNA, 498 bp, Homo sapiens
  misc_feature: HIJSMM301A3UDF.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggctactggtatcccagccaggttcagtggcagtgggtctgggacagagttcactctcaccatcagcagcctgcagtctgaagattttgcggtttattactgtcagcagtataataactggcctccacggtacacttttggccagggggaccaagctggagatcaaacgaactgtggctgcaccatctgtt

SEQ ID NO: 594300 - DNA, 516 bp, Homo sapiens
  misc_feature: HIJSMM301APD5V.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagtttttctcggggcgttcggtccaacgggaccaagggtaggaaagtacaaaacgaactagtggtctgcaccactctgtcttctatcttccccg

SEQ ID NO: 594301 - DNA, 509 bp, Homo sapiens
  misc_feature: HIJSMM301D14A5.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcaggtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcta

SEQ ID NO: 594302 - DNA, 515 bp, Homo sapiens
  misc_feature: HIJSMM301EV4LL.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaggtggcaatcaaccgaactgtggctgcaccatctgtcttcatcttcccg

SEQ ID NO: 594303 - DNA, 487 bp, Homo sapiens; identical to SEQ ID NO: 539157
  misc_feature: HIJSMM301BBDQO.26.37.D04.1.454.light.4.raw

SEQ ID NO: 594304 - DNA, 510 bp, Homo sapiens
  misc_feature: HIJSMM301BI89S.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagacccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactctcg

SEQ ID NO: 594305 - DNA, 505 bp, Homo sapiens
  misc_feature: HIJSMM301C4TG0.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttccttttttgtcttcggaactgggaccgaggtcaccgtcctaggtcagcccaaggccaaccccactgtcta

SEQ ID NO: 594306 - DNA, 492 bp, Homo sapiens
  misc_feature: HIJSMM301EMV9U.46.26.C04.1.454.light.4.raw
  modified_base (444)..(444): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctatatgcatgcaagctctacaagtccccgntcactttcggcggagggaccaagggtcggaggatcgaaaacgaacttc

SEQ ID NO: 594307 - DNA, 507 bp, Homo sapiens
  misc_feature: HIJSMM301AQV5T.19.67.G01.1.454.light.4.raw
  modified_base (500)..(500): a, c, t, g, unknown or other
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttcttatcctccgtggacgttcggccaagggaccagggtggaaatacagacgaactgtggtcngcaccat

SEQ ID NO: 594308 - DNA, 462 bp, Homo sapiens; identical to SEQ ID NO: 553042
  misc_feature: HIJSMM301D5EK6.49.8.A08.1.454.light.4.raw

SEQ ID NO: 594309 - DNA, 518 bp, Homo sapiens; identical to SEQ ID NO: 540171
  misc_feature: HIJSMM301A57LE.49.10.A10.1.454.light.4.raw

SEQ ID NO: 594310 - DNA, 496 bp, Homo sapiens; identical to SEQ ID NO: 548829
  misc_feature: HIJSMM301BDXL1.16.10.A10.1.454.light.4.raw

SEQ ID NO: 594311 - DNA, 491 bp, Homo sapiens; identical to SEQ ID NO: 535294
  misc_feature: HIJSMM301A1AS1.16.68.G02.1.454.light.4.raw

SEQ ID NO: 594312 - DNA, 521 bp, Homo sapiens; identical to SEQ ID NO: 539470
  misc_feature: HIJSMM301B5Z58.27.23.C01.1.454.light.4.raw

SEQ ID NO: 594313 - DNA, 515 bp, Homo sapiens
  misc_feature: HIJSMM301DMG4Z.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccgaagctgaccgtcctaggtcagcccaaggctgccccctcggtcactctgttcccgccctcctcagacgtatca

SEQ ID NO: 594314 - DNA, 501 bp, Homo sapiens; identical to SEQ ID NO: 535746
  misc_feature: HIJSMM301E316G.18.11.A11.1.454.light.4.raw

SEQ ID NO: 594315 - DNA, 485 bp, Homo sapiens; identical to SEQ ID NO: 536040
  misc_feature: HIJSMM301AKDX0.15.1.A01.1.454.light.4.raw

SEQ ID NO: 594316 - DNA, 492 bp, Homo sapiens; identical to SEQ ID NO: 548815
  misc_feature: HIJSMM301EP0WD.22.65.F10.1.454.light.4.raw

SEQ ID NO: 594317 - DNA, 486 bp, Homo sapiens; identical to SEQ ID NO: 537127
  misc_feature: HIJSMM301COF67.3.77.G11.1.454.light.4.raw

SEQ ID NO: 594318 - DNA, 486 bp, Homo sapiens
  misc_feature: HIJSMM301AJUEJ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgagcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtctt

SEQ ID NO: 594319 - DNA, 484 bp, Homo sapiens; identical to SEQ ID NO: 535400
  misc_feature: HIJSMM301B5WRI.46.26.C04.1.454.light.4.raw

SEQ ID NO: 594320 - DNA, 479 bp, Homo sapiens
  misc_feature: HIJSMM301BVC6L.41.36.D03.1.454.light.4.raw
tctatactatcacgaccggtgctcgatttagctgcgtcacgatctctcttggggctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgtacccg

SEQ ID NO: 594321 - DNA, 509 bp, Homo sapiens
  misc_feature: HIJSMM301ASLQ1.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatctttccg

SEQ ID NO: 594322 - DNA, 462 bp, Homo sapiens
  misc_feature: HIJSMM301BH02E.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcgcgagggaccaaggtggagata

SEQ ID NO: 594323 - DNA, 498 bp, Homo sapiens
  misc_feature: HIJSMM301A9531.51.58.F03.1.454.light.4.raw
cgatcgtatacacgaccggtgctcgatttagtctgatcgagaagggaaagggggaactgagctacaacaggcaggcaggggcagcaagatggtgttgcagacccaggtcttcatttctctgttgctctggatctctggtgcctacggggacatcgtgatgacccagtctccagagtccctggctgtgtctctgggcgagagggccaccatcacctgcaagtccagccagagtgttttatacagcggcaacaataagaattacttagcttggcaccagcagaaactaggacagcctcctaagttgctcatctcctgggcatctacccgggaatccggggtccctgaccgattcagtggcagcgggtctgggacagatttcactctcaccatcaacaacctgcaggctgaggatgtggcagtttattactgtcagcaatattacagtactcttccgatcaccttcggccaagggacgcgactggagattaaacgaactgt

SEQ ID NO: 594324 - DNA, 496 bp, Homo sapiens; identical to SEQ ID NO: 553382
  misc_feature: HIJSMM301B70G8.51.59.F04.1.454.light.4.raw

SEQ ID NO: 594325 - DNA, 486 bp, Homo sapiens
  misc_feature: HIJSMM301DZIZY.19.71.G05.1.454.light.4.raw
  modified_base (235)..(235): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcgaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 594326 - DNA, 527 bp, Homo sapiens
  misc_feature: HIJSMM301CPJW7.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccgaacggttgtaccgtcctaacgttcagcccaaggctcgccccctccggtcacctctcgttccccg

SEQ ID NO: 594327 - DNA, 475 bp, Homo sapiens
  misc_feature: HIJSMM301D410N.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaaagtataacagtgcccccttcacccttcggccaagggacacgactggagattagacg

SEQ ID NO: 594328 - DNA, 501 bp, Homo sapiens
  misc_feature: HIJSMM301B1WT1.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcaccgtcctaggtcagcccaaggccaaccc

SEQ ID NO: 594329 - DNA, 506 bp, Homo sapiens
  misc_feature: HIJSMM301A02IO.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggcccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggaccaaactggaaccgtcgtaggtcagcccaa

SEQ ID NO: 594330 - DNA, 475 bp, Homo sapiens; identical to SEQ ID NO: 560950
  misc_feature: HIJSMM301EFNXV.5.12.B01.1.454.light.4.raw

SEQ ID NO: 594331 - DNA, 495 bp, Homo sapiens; identical to SEQ ID NO: 543876
  misc_feature: HIJSMM301DPK3T.2.49.E05.1.454.light.4.raw

SEQ ID NO: 594332 - DNA, 521 bp, Homo sapiens; identical to SEQ ID NO: 539470
  misc_feature: HIJSMM301A0BPU.27.23.C01.1.454.light.4.raw

SEQ ID NO: 594333 - DNA, 459 bp, Homo sapiens
  misc_feature: HIJSMM301ALSZX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtggaacggttccggttttcggcggagggaccaagctgaccgtcctaagtcagcccaaggctcgccccctcggtcactctcgttccccaccctcctccacgagagta

SEQ ID NO: 594334 - DNA, 484 bp, Homo sapiens; identical to SEQ ID NO: 535400
  misc_feature: HIJSMM301DO8V3.46.26.C04.1.454.light.4.raw

SEQ ID NO: 594335 - DNA, 498 bp, Homo sapiens
  misc_feature: HIJSMM301AHYIR.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 594336 - DNA, 492 bp, Homo sapiens; identical to SEQ ID NO: 548815
  misc_feature: HIJSMM301DPLJK.22.65.F10.1.454.light.4.raw

SEQ ID NO: 594337 - DNA, 477 bp, Homo sapiens
  misc_feature: HIJSMM301CNLLY.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgctaacttacttctgtcaacagagttacagttccctcactttcggccctgggaccatagtggatatcaaacgaactgtggctgcacc

SEQ ID NO: 594338 - DNA, 443 bp, Homo sapiens; identical to SEQ ID NO: 543663
  misc_feature: HIJSMM301CPXYY.2.76.G10.1.454.light.4.raw

SEQ ID NO: 594339 - DNA, 506 bp, Homo sapiens; identical to SEQ ID NO: 539926
  misc_feature: HIJSMM301DRXRO.5.24.C02.1.454.light.4.raw

SEQ ID NO: 594340 - DNA, 493 bp, Homo sapiens; identical to SEQ ID NO: 535745
  misc_feature: HIJSMM301BDF2O.47.78.H01.1.454.light.4.raw

SEQ ID NO: 594341 - DNA, 510 bp, Homo sapiens
  misc_feature: HIJSMM301AKUT3.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtaggagtatcaaacgaaactgtggctgcaccatctgtctt

SEQ ID NO: 594342 - DNA, 517 bp, Homo sapiens
  misc_feature: HIJSMM301C5B31.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagacccctggagcctcagttggaagcagccgatccagcctgcggagcctgtgggcaggtcagcccaaggctgccccctcggtcactctgttcccgcctcctccacg

SEQ ID NO: 594343 - DNA, 504 bp, Homo sapiens
  misc_feature: HIJSMM301A0A79.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccagacccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccgaagctgaccgtcctaggttcagcccaaggctgccccctcggtcactctgttccccg

SEQ ID NO: 594344 - DNA, 504 bp, Homo sapiens
  misc_feature: HIJSMM301A3NHA.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactg

SEQ ID NO: 594345 - DNA, 497 bp, Homo sapiens
  misc_feature: HIJSMM301EFDEN.13.76.G10.1.454.light.4.raw
tcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctgggtccctcatcgcttctctggctccatccttgggaacaaagctgcccttatcatcacggggcccaggcagaagatgaatctgattattactgtgttctttatatgggtagtgccatttctgctgtgttcggaggaggcacccggctgaccgtcctcggtcagcccaaggctgcccactc

SEQ ID NO: 594346 - DNA, 500 bp, Homo sapiens
  misc_feature: HIJSMM301DKZDU.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccgaaactgaccgtcctaggtcagcccaaggctgccccccg

SEQ ID NO: 594347 - DNA, 496 bp, Homo sapiens; identical to SEQ ID NO: 536690
  misc_feature: HIJSMM301CY9O0.40.23.C01.1.454.light.4.raw

SEQ ID NO: 594348 - DNA, 484 bp, Homo sapiens; identical to SEQ ID NO: 537878
  misc_feature: HIJSMM301DWDF0.17.34.D01.1.454.light.4.raw

SEQ ID NO: 594349 - DNA, 530 bp, Homo sapiens
  misc_feature: HIJSMM301BFSNN.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtcgtccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaaggtacgaaacgaactagtggcgtgcgaccactctcgtcttcctactcttcccgtcctactctacgt

SEQ ID NO: 594350 - DNA, 493 bp, Homo sapiens; identical to SEQ ID NO: 537422
  misc_feature: HIJSMM301BCVYL.9.34.D01.1.454.light.4.raw

SEQ ID NO: 594351 - DNA, 505 bp, Homo sapiens; identical to SEQ ID NO: 535503
  misc_feature: HIJSMM301A705V.8.28.C06.1.454.light.4.raw

SEQ ID NO: 594352 - DNA, 494 bp, Homo sapiens; identical to SEQ ID NO: 534992
  misc_feature: HIJSMM301EKS2D.9.1.A01.1.454.light.4.raw

SEQ ID NO: 594353 - DNA, 517 bp, Homo sapiens; identical to SEQ ID NO: 587003
  misc_feature: HIJSMM301CRLSQ.22.30.C08.1.454.light.4.raw

SEQ ID NO: 594354 - DNA, 440 bp, Homo sapiens
  misc_feature: HIJSMM301BK88B.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggcccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataga

SEQ ID NO: 594355 - DNA, 489 bp, Homo sapiens; identical to SEQ ID NO: 542780
  misc_feature: HIJSMM301C8PI7.16.53.E09.1.454.light.4.raw

SEQ ID NO: 594356 - DNA, 494 bp, Homo sapiens; identical to SEQ ID NO: 540645
  misc_feature: HIJSMM301BJC9D.13.38.D05.1.454.light.4.raw

SEQ ID NO: 594357 - DNA, 506 bp, Homo sapiens
  misc_feature: HIJSMM301BLSGT.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggcctcgggaccaaagtggatatcaaacgaactgtggctgcaccatctgtctt

SEQ ID NO: 594358 - DNA, 500 bp, Homo sapiens
  misc_feature: HIJSMM301AFQKC.43.27.C05.1.454.light.4.raw
tgtgagtagtcacgaccggtgctcgatttagacgcgatcgaagggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccca

SEQ ID NO: 594359 - DNA, 472 bp, Homo sapiens; identical to SEQ ID NO: 535898
  misc_feature: HIJSMM301BAMKW.15.8.A08.1.454.light.4.raw

SEQ ID NO: 594360 - DNA, 503 bp, Homo sapiens; identical to SEQ ID NO: 580238
  misc_feature: HIJSMM301AYPP0.51.2.A02.1.454.light.4.raw

SEQ ID NO: 594361 - DNA, 447 bp, Homo sapiens; identical to SEQ ID NO: 535020
  misc_feature: HIJSMM301EX25F.18.9.A09.1.454.light.4.raw

SEQ ID NO: 594362 - DNA, 496 bp, Homo sapiens; identical to SEQ ID NO: 551939
  misc_feature: HIJSMM301AZL1L.19.71.G05.1.454.light.4.raw

SEQ ID NO: 594363 - DNA, 492 bp, Homo sapiens; identical to SEQ ID NO: 557028
  misc_feature: HIJSMM301BN0B1.51.6.A06.1.454.light.4.raw

SEQ ID NO: 594364 - DNA, 486 bp, Homo sapiens
  misc_feature: HIJSMM301C8IN1.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcgcggacaagtgacgtcctacg

SEQ ID NO: 594365 - DNA, 511 bp, Homo sapiens; identical to SEQ ID NO: 537464
  misc_feature: HIJSMM301A00T1.7.34.D01.1.454.light.4.raw

SEQ ID NO: 594366 - DNA, 495 bp, Homo sapiens; identical to SEQ ID NO: 535821
  misc_feature: HIJSMM301C3HE3.3.31.C09.1.454.light.4.raw

SEQ ID NO: 594367 - DNA, 519 bp, Homo sapiens
  misc_feature: HIJSMM301EYXVJ.41.19.B08.1.454.light.4.raw
tctatactatcacgaccggtgctcgatttagtgagtcagtaaggggaggtgatgcctccagggaaggggcttcggtgacctctgggctgatccttggtctcctgctcctcaggctcaccaggccccggctctgactcactggcatgtatttctccctctttccagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaagg

SEQ ID NO: 594368 - DNA, 509 bp, Homo sapiens
  misc_feature: HIJSMM301EBJPY.40.26.C04.1.454.light.4.raw
tctagcgactcacgaccggtgctcgatttagtctagcgactttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcaccagcgtagcagctggcctcgaacgttcggccaagggaccaaggtggacatcaagcgaactgtggctgcgacccatctgtcttcatcttccccg

SEQ ID NO: 594369 - DNA, 488 bp, Homo sapiens; identical to SEQ ID NO: 574551
  misc_feature: HIJSMM301CX17C.47.36.D03.1.454.light.4.raw

SEQ ID NO: 594370 - DNA, 495 bp, Homo sapiens
  misc_feature: HIJSMM301EC8JY.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctctactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctgca

SEQ ID NO: 594371 - DNA, 488 bp, Homo sapiens; identical to SEQ ID NO: 551155
  misc_feature: HIJSMM301CFDAX.3.33.C11.1.454.light.4.raw

SEQ ID NO: 594372 - DNA, 497 bp, Homo sapiens; identical to SEQ ID NO: 536371
  misc_feature: HIJSMM301ATF56.16.78.H01.1.454.light.4.raw

SEQ ID NO: 594373 - DNA, 497 bp, Homo sapiens; identical to SEQ ID NO: 535286
  misc_feature: HIJSMM301DD2RD.18.59.F04.1.454.light.4.raw

SEQ ID NO: 594374 - DNA, 487 bp, Homo sapiens
  misc_feature: HIJSMM301BC0HT.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctcgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctaccgtgagct

SEQ ID NO: 594375 - DNA, 487 bp, Homo sapiens; identical to SEQ ID NO: 535583
  misc_feature: HIJSMM301D3KFR.22.73.G07.1.454.light.4.raw

SEQ ID NO: 594376 - DNA, 508 bp, Homo sapiens
  misc_feature: HIJSMM301BT485.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctggtcactctgttccccg

SEQ ID NO: 594377 - DNA, 446 bp, Homo sapiens
  misc_feature: HIJSMM301DV07X.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctcgttcccacccctcctcgtgtctgat

SEQ ID NO: 594378 - DNA, 489 bp, Homo sapiens; identical to SEQ ID NO: 537328
  misc_feature: HIJSMM301D2EC1.13.5.A05.1.454.light.4.raw

SEQ ID NO: 594379 - DNA, 503 bp, Homo sapiens
  misc_feature: HIJSMM301C21IK.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccactgtcactctgttcccaccct

SEQ ID NO: 594380 - DNA, 494 bp, Homo sapiens; identical to SEQ ID NO: 534992
  misc_feature: HIJSMM301A9J6M.9.1.A01.1.454.light.4.raw

SEQ ID NO: 594381 - DNA, 496 bp, Homo sapiens
  misc_feature: HIJSMM301BHZG2.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctgagatcaaacgaactgtggctgcaccatctgtt

SEQ ID NO: 594382 - DNA, 493 bp, Homo sapiens; identical to SEQ ID NO: 535084
  misc_feature: HIJSMM301CNG9S.47.64.F09.1.454.light.4.raw

SEQ ID NO: 594383 - DNA, 493 bp, Homo sapiens
  misc_feature: HIJSMM301CCB0H.3.3.A03.1.454.light.4.raw
agacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggacgttcggccaagggaccaaggtaggaaatacaaccgaactgtggctgcgaccatctgtcttc

SEQ ID NO: 594384 - DNA, 507 bp, Homo sapiens
  misc_feature: HIJSMM301BK9A6.3.79.H02.1.454.light.4.raw
  modified_base (458)..(458): a, c, t, g, unknown or other
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgacccatctcggggctccaggctgaggacgaggctgcttattactgcagctcatatacaaggagcaccactctcgtggtatttggnggagggaccaagctgaccgtctaggtcagcccaaggctgccccctcggt

SEQ ID NO: 594385 - DNA, 494 bp, Homo sapiens; identical to SEQ ID NO: 534992
  misc_feature: HIJSMM301BH20R.9.1.A01.1.454.light.4.raw

SEQ ID NO: 594386 - DNA, 507 bp, Homo sapiens; identical to SEQ ID NO: 559315
  misc_feature: HIJSMM301B2559.47.55.E11.1.454.light.4.raw

SEQ ID NO: 594387 - DNA, 506 bp, Homo sapiens
  misc_feature: HIJSMM301A3FFV.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccacctgtcta

SEQ ID NO: 594388 - DNA, 497 bp, Homo sapiens; identical to SEQ ID NO: 536371
  misc_feature: HIJSMM301CGOWB.16.78.H01.1.454.light.4.raw

SEQ ID NO: 594389 - DNA, 487 bp, Homo sapiens
  misc_feature: HIJSMM301DEHXM.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggatatcagacgaa

SEQ ID NO: 594390 - DNA, 444 bp, Homo sapiens; identical to SEQ ID NO: 535027
  misc_feature: HIJSMM301CGKTG.8.73.G07.1.454.light.4.raw

SEQ ID NO: 594391 - DNA, 483 bp, Homo sapiens
  misc_feature: HIJSMM301AWIIC.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatccttcccgccatctgactagtcta

SEQ ID NO: 594392 - DNA, 526 bp, Homo sapiens
  misc_feature: HIJSMM301DP16S.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagccgtggtggggcagggtcaggcccaaggcccaaccccactgtccactcttccg

SEQ ID NO: 594393 - DNA, 482 bp, Homo sapiens
  misc_feature: HIJSMM301CQ4G2.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggccaaggtggagatcaacgaa

SEQ ID NO: 594394 - DNA, 494 bp, Homo sapiens; identical to SEQ ID NO: 535680
  misc_feature: HIJSMM301EKMAO.16.78.H01.1.454.light.4.raw

SEQ ID NO: 594395 - DNA, 488 bp, Homo sapiens
  misc_feature: HIJSMM301EIH2I.26.23.C01.1.454.light.4.raw
  modified_base (484)..(484): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccanctgt

SEQ ID NO: 594396 - DNA, 494 bp, Homo sapiens; identical to SEQ ID NO: 537805
  misc_feature: HIJSMM301ANADE.51.6.A06.1.454.light.4.raw

SEQ ID NO: 594397 - DNA, 502 bp, Homo sapiens; identical to SEQ ID NO: 541971
  misc_feature: HIJSMM301DDAZV.4.39.D06.1.454.light.4.raw

SEQ ID NO: 594398 - DNA, 505 bp, Homo sapiens; identical to SEQ ID NO: 551816
  misc_feature: HIJSMM301D9HHW.18.78.H01.1.454.light.4.raw

SEQ ID NO: 594399 - DNA, 494 bp, Homo sapiens; identical to SEQ ID NO: 535478
  misc_feature: HIJSMM301D8HCY.10.79.H02.1.454.light.4.raw

SEQ ID NO: 594400 - DNA, 500 bp, Homo sapiens
  misc_feature: HIJSMM301AEK9E.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 594401 - DNA, 520 bp, Homo sapiens; identical to SEQ ID NO: 546218
  misc_feature: HIJSMM301CZHNL.12.71.G05.1.454.light.4.raw

SEQ ID NO: 594402 - DNA, 487 bp, Homo sapiens
  misc_feature: HIJSMM301CZ26C.49.38.D05.1.454.light.4.raw
agtcgagagacacgaccggtgctcgatttagtatctgatagttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggagatcaaacgaacg

SEQ ID NO: 594403 - DNA, 508 bp, Homo sapiens
  misc_feature: HIJSMM301AJGJY.51.35.D02.1.454.light.4.raw
cgatcgtatacacgaccggtgctcgatttagcacacgatagttgggtttgggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcact

SEQ ID NO: 594404 - DNA, 500 bp, Homo sapiens; identical to SEQ ID NO: 548721
  misc_feature: HIJSMM301AYJ07.14.35.D02.1.454.light.4.raw

SEQ ID NO: 594405 - DNA, 483 bp, Homo sapiens
  misc_feature: HIJSMM301A6YH1.49.28.C06.1.454.light.4.raw
agtcgagagacacgaccggtgctcgatttagagctcacgtattgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggaggaccagggtggagatcaaacg

SEQ ID NO: 594406 - DNA, 488 bp, Homo sapiens
  misc_feature: HIJSMM301D06NI.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatccaaacgaactgtggctgcaccatctgt

SEQ ID NO: 594407 - DNA, 489 bp, Homo sapiens
  misc_feature: HIJSMM301B9TKS.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtgctgcaccatctgtcttcat

SEQ ID NO: 594408 - DNA, 486 bp, Homo sapiens; identical to SEQ ID NO: 536323
  misc_feature: HIJSMM301BQHGH.10.2.A02.1.454.light.4.raw

SEQ ID NO: 594409 - DNA, 505 bp, Homo sapiens; identical to SEQ ID NO: 536254
  misc_feature: HIJSMM301DQ0VL.7.71.G05.1.454.light.4.raw

SEQ ID NO: 594410 - DNA, 512 bp, Homo sapiens
  misc_feature: HIJSMM301CJKYH.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtactttcggtcggagggaccgaagactgaccgtccgtcgggtcgagcccaacggcgtgccccctccggtcta

SEQ ID NO: 594411 - DNA, 493 bp, Homo sapiens
  misc_feature: HIJSMM301DGZIC.51.71.G05.1.454.light.4.raw
cgatcgtatacacgaccggtgctcgatttagtgtcgtcgcaagagagagggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 594412 - DNA, 505 bp, Homo sapiens
  misc_feature: HIJSMM301A9PG3.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggacccccaaatcctcatccagaggaataatcagcggccctcaggggtccctgaccgattctctggctccaagtctggcacctcagcctccctgaccatcagtgggctccggtccgaggatgaggctgactatta

SEQ ID NO: 594413 - DNA, 494 bp, Homo sapiens
  misc_feature: HIJSMM301CJJR9.3.78.H01.1.454.light.4.raw
agacgcactccacgaccggtgctcgatttagtgtgagtagtttgggtttgggggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatt

SEQ ID NO: 594414 - DNA, 444 bp, Homo sapiens; identical to SEQ ID NO: 535856
  misc_feature: HIJSMM301E13XY.9.9.A09.1.454.light.4.raw

SEQ ID NO: 594415 - DNA, 463 bp, Homo sapiens; identical to SEQ ID NO: 546175
  misc_feature: HIJSMM301CEI8D.17.28.C06.1.454.light.4.raw

SEQ ID NO: 594416 - DNA, 500 bp, Homo sapiens
  misc_feature: HIJSMM301DSB42.5.24.C02.1.454.light.4.raw
atcagacacgcacgaccggtgctcgatttagtacagatcgttagggaaaggggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccaacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaagg

SEQ ID NO: 594417 - DNA, 475 bp, Homo sapiens
  misc_feature: HIJSMM301DV79B.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtgccaaggacgaaacgtagacgatacaagacgaacagt

SEQ ID NO: 594418 - DNA, 501 bp, Homo sapiens
  misc_feature: HIJSMM301DGWW6.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgcctcctcgctacgtaga

SEQ ID NO: 594419 - DNA, 447 bp, Homo sapiens; identical to SEQ ID NO: 535020
  misc_feature: HIJSMM301EYP23.18.9.A09.1.454.light.4.raw

SEQ ID NO: 594420 - DNA, 484 bp, Homo sapiens
  misc_feature: HIJSMM301ARZ6C.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagagtgggaaatatgtggtattcgggcggagggaccaaactgaccgtcctaggtcagcccaaggctgcccccc

SEQ ID NO: 594421 - DNA, 502 bp, Homo sapiens; identical to SEQ ID NO: 536253
  misc_feature: HIJSMM301ETSB8.21.22.B11.1.454.light.4.raw

SEQ ID NO: 594422 - DNA, 500 bp, Homo sapiens
  misc_feature: HIJSMM301CB1BD.43.53.E09.1.454.light.4.raw
tgtgagtagtcacgaccggtgctcgatttagagagagtgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattggggacacggtcaccgtcctaggtcagcccaaggccaacccca

SEQ ID NO: 594423 - DNA, 487 bp, Homo sapiens
  misc_feature: HIJSMM301BOJTS.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 594424 - DNA, 508 bp, Homo sapiens
  misc_feature: HIJSMM301A3866.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatcaaacgaactgtggctgcaccatctgtctt

SEQ ID NO: 594425 - DNA, 520 bp, Homo sapiens; identical to SEQ ID NO: 537173
  misc_feature: HIJSMM301BJF3K.27.23.C01.1.454.light.4.raw

SEQ ID NO: 594426 - DNA, 503 bp, Homo sapiens; identical to SEQ ID NO: 535140
  misc_feature: HIJSMM301BU2YX.18.37.D04.1.454.light.4.raw

SEQ ID NO: 594427 - DNA, 489 bp, Homo sapiens
  misc_feature: HIJSMM301DF9YI.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatcaaacgaactgtggctgcaccatctgtcttcat

SEQ ID NO: 594428 - DNA, 519 bp, Homo sapiens
  misc_feature: HIJSMM301EBZW8.27.23.C01.1.454.light.4.raw
agcgtcgtctcacgaccggtgctcgatttagtacacgtgattagggattggggggggtctcaggaggcagcgctctcgggacgtctccaccatggccgtgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagccaaggctgccccctcggtcactctgttcccacct

SEQ ID NO: 594429 - DNA, 454 bp, Homo sapiens; identical to SEQ ID NO: 534964
  misc_feature: HIJSMM301DC7UJ.19.86.H09.1.454.light.4.raw

SEQ ID NO: 594430 - DNA, 484 bp, Homo sapiens
  misc_feature: HIJSMM301DVT2M.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggaggaccaaggtggagatcaaacgaa

SEQ ID NO: 594431 - DNA, 504 bp, Homo sapiens
  misc_feature: HIJSMM301BTTAS.48.28.C06.1.454.light.4.raw
agtatacatacacgaccggtgctcgatttagagctcacgtattgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 594432 - DNA, 485 bp, Homo sapiens; identical to SEQ ID NO: 536210
  misc_feature: HIJSMM301BYQPT.43.54.E10.1.454.light.4.raw

SEQ ID NO: 594433 - DNA, 498 bp, Homo sapiens; identical to SEQ ID NO: 540839
  misc_feature: HIJSMM301BKBUZ.48.38.D05.1.454.light.4.raw

SEQ ID NO: 594434 - DNA, 495 bp, Homo sapiens
  misc_feature: HIJSMM301B64F4.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatacaaacgaact

SEQ ID NO: 594435 - DNA, 484 bp, Homo sapiens
  misc_feature: HIJSMM301AP3Q0.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagtgaccgaggtggaattcaaacgaactgtggctgcaccatctgtt

SEQ ID NO: 594436 - DNA, 502 bp, Homo sapiens
  misc_feature: HIJSMM301DK0Y9.51.33.C11.1.454.light.4.raw
cgatcgtatacacgaccggtgctcgatttagagtgagctcgttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtggctgcaccatctgtcttcta

SEQ ID NO: 594437 - DNA, 496 bp, Homo sapiens; identical to SEQ ID NO: 565179
  misc_feature: HIJSMM301B1VNG.48.48.E04.1.454.light.4.raw

SEQ ID NO: 594438 - DNA, 494 bp, Homo sapiens; identical to SEQ ID NO: 579885
  misc_feature: HIJSMM301CUE3L.4.27.C05.1.454.light.4.raw

SEQ ID NO: 594439 - DNA, 496 bp, Homo sapiens
  misc_feature: HIJSMM301EDD99.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccaaggtggagatacaaacgaaactgtggctgcaccatctgtcttcatcttcccg

SEQ ID NO: 594440 - DNA, 493 bp, Homo sapiens; identical to SEQ ID NO: 566632
  misc_feature: HIJSMM301C5TAH.27.78.H01.1.454.light.4.raw

SEQ ID NO: 594441 - DNA, 490 bp, Homo sapiens
  misc_feature: HIJSMM301AJTFH.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggacgggaccgaaggcggagatcagacgaactgtgctgcacatctgtcttcta

SEQ ID NO: 594442 - DNA, 482 bp, Homo sapiens
  misc_feature: HIJSMM301B3G6I.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtaggaaatactaaacgaactgtgg

SEQ ID NO: 594443 - DNA, 492 bp, Homo sapiens
  misc_feature: HIJSMM301CXEV0.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtgcagtggatcaggcacagattttacactagaaaatcagcagagtggaggctgaggatgttgggctctattatgcatgcaagctctacaacgtcccgctccacgtttcggcgggagggaccgaaggtggagatacaaacgaactt

SEQ ID NO: 594444 - DNA, 513 bp, Homo sapiens
  misc_feature: HIJSMM301DEEE4.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagccaaggctgccccctcggtcactctgttcccta

SEQ ID NO: 594445 - DNA, 486 bp, Homo sapiens; identical to SEQ ID NO: 535043
  misc_feature: HIJSMM301DXCU1.46.35.D02.1.454.light.4.raw

SEQ ID NO: 594446 - DNA, 483 bp, Homo sapiens; identical to SEQ ID NO: 542200
  misc_feature: HIJSMM301D1NHS.7.75.G09.1.454.light.4.raw

SEQ ID NO: 594447 - DNA, 497 bp, Homo sapiens; identical to SEQ ID NO: 543223
  misc_feature: HIJSMM301APP95.43.39.D06.1.454.light.4.raw

SEQ ID NO: 594448 - DNA, 497 bp, Homo sapiens; identical to SEQ ID NO: 536371
  misc_feature: HIJSMM301DN7P9.16.78.H01.1.454.light.4.raw

SEQ ID NO: 594449 - DNA, 501 bp, Homo sapiens; identical to SEQ ID NO: 555551
  misc_feature: HIJSMM301AZR4Q.21.81.H04.1.454.light.4.raw

SEQ ID NO: 594450 - DNA, 511 bp, Homo sapiens
  misc_feature: HIJSMM301DFNZC.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctggaggacgaggctgattattactgcagcttatatacaggcaacaatacttttgtcttcggaactgggaccaaggtcaccgtcctaggtcagcccaaggccaaccccactgtcactctcg

SEQ ID NO: 594451 - DNA, 503 bp, Homo sapiens
  misc_feature: HIJSMM301CCRAH.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctcgccccctcggtcactctgttcccaccctccctcgctacgtaga

SEQ ID NO: 594452 - DNA, 520 bp, Homo sapiens; identical to SEQ ID NO: 542144
  misc_feature: HIJSMM301BXSRE.48.24.C02.1.454.light.4.raw

SEQ ID NO: 594453 - DNA, 529 bp, Homo sapiens
  misc_feature: HIJSMM301CLRXR.14.70.G04.1.454.light.4.raw
  modified_base (443)..(443): a, c, t, g, unknown or other
  modified_base (452)..(452): a, c, t, g, unknown or other
  modified_base (486)..(486): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagacctcgagcctcngtggtaagnacgcgatccagcctgcggaggcctgtggggacgnggtcgagcccaacggcccgaaccccaacctccgtcactcttcg

SEQ ID NO: 594454 - DNA, 483 bp, Homo sapiens
  misc_feature: HIJSMM301DE1TM.48.19.B08.1.454.light.4.raw
  modified_base (434)..(434): a, c, t, g, unknown or other
  modified_base (442)..(442): a, c, t, g, unknown or other
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctaacncttgggtnttcggcggagggaccaagctgaccgtcctaggtcagcccaa

SEQ ID NO: 594455 - DNA, 491 bp, Homo sapiens; identical to SEQ ID NO: 536211
  misc_feature: HIJSMM301CWSZH.16.53.E09.1.454.light.4.raw

SEQ ID NO: 594456 - DNA, 496 bp, Homo sapiens; identical to SEQ ID NO: 537925
  misc_feature: HIJSMM301AU7K3.22.14.B03.1.454.light.4.raw

SEQ ID NO: 594457 - DNA, 515 bp, Homo sapiens; identical to SEQ ID NO: 569738
  misc_feature: HIJSMM301A7QYL.14.19.B08.1.454.light.4.raw
  modified_base (506)..(506): a, c, t, g, unknown or other

SEQ ID NO: 594458 - DNA, 501 bp, Homo sapiens
  misc_feature: HIJSMM301AIE6L.2.76.G10.1.454.light.4.raw
acgctcgacacacgaccggtgctcgatttagtcactcatacaggggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtcttggt

SEQ ID NO: 594459 - DNA, 491 bp, Homo sapiens
  misc_feature: HIJSMM301ADQ9H.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctactaaactccttactacttttggccaggggaccaagctggagatcaaacgaact

SEQ ID NO: 594460 - DNA, 496 bp, Homo sapiens
  misc_feature: HIJSMM301EF6C3.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactgggctcaggcggaagatgaggctgactattactgtaactcccggccagcagtggtaacattgtgatattcggcggagggaccaaggtgaccgtcctacgtccagcccaaggctgccccctcggtcactctcg

SEQ ID NO: 594461 - DNA, 498 bp, Homo sapiens; identical to SEQ ID NO: 551184
  misc_feature: HIJSMM301A7BM5.40.57.F02.1.454.light.4.raw

SEQ ID NO: 594462 - DNA, 484 bp, Homo sapiens; identical to SEQ ID NO: 535240
  misc_feature: HIJSMM301B825K.47.60.F05.1.454.light.4.raw

SEQ ID NO: 594463 - DNA, 501 bp, Homo sapiens
  misc_feature: HIJSMM301BM8GQ.52.2.A02.1.454.light.4.raw
cgcagtacgacacgaccggtgctcgatttagactcatctacaggggaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagccgtgtggggcaggtcaggcccaagggccaacccactgtcactctcgttcccgccctcctctatacgatcg

SEQ ID NO: 594464 - DNA, 485 bp, Homo sapiens
  misc_feature: HIJSMM301AVPZG.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggtttcggtcggagggaccaagctgaccgtcctaggtcagaccccg

SEQ ID NO: 594465 - DNA, 504 bp, Homo sapiens; identical to SEQ ID NO: 535128
  misc_feature: HIJSMM301EC8O3.19.85.H08.1.454.light.4.raw

SEQ ID NO: 594466 - DNA, 483 bp, Homo sapiens
  misc_feature: HIJSMM301CO071.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttgccgagggaccaagctggagatcaaacgaactgtgctgcacat

SEQ ID NO: 594467 - DNA, 484 bp, Homo sapiens
  misc_feature: HIJSMM301CEZAX.49.41.D08.1.454.light.4.raw
agtcgagagacacgaccggtgctcgatttagtcacgcgagaaagggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacatttttggcctaggggaccaagttggagatcaaacgaaactgtggctgcacc

SEQ ID NO: 594468 - DNA, 489 bp, Homo sapiens
  misc_feature: HIJSMM301EVB9E.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggtagggaccaaggtggagatcaagcgaactgtggctgcaccat

SEQ ID NO: 594469 - DNA, 491 bp, Homo sapiens; identical to SEQ ID NO: 538524
  misc_feature: HIJSMM301DJRGH.19.25.C03.1.454.light.4.raw

SEQ ID NO: 594470 - DNA, 473 bp, Homo sapiens; identical to SEQ ID NO: 541215
  misc_feature: HIJSMM301EGCWN.13.48.E04.1.454.light.4.raw

SEQ ID NO: 594471 - DNA, 525 bp, Homo sapiens
  misc_feature: HIJSMM301ADNVR.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggacggaacggtaggaggttacgtaaacgaaactagtgggtcgtgtcgaccaactcttcgttcttcttactctttcccgt

SEQ ID NO: 594472 - DNA, 499 bp, Homo sapiens
  misc_feature: HIJSMM301AVUMA.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtactcccagaccggttcagtggcagtgggtctgggacagacttcactctcaccatcagcagtctgcagtctgaagattttgctagtttattactgtcagcagtataataactggcctccgtacatgtactacttttggccgacggggaccaaccgtggagatcagacgaa

SEQ ID NO: 594473 - DNA, 447 bp, Homo sapiens; identical to SEQ ID NO: 535020
  misc_feature: HIJSMM301AJQA8.18.9.A09.1.454.light.4.raw

SEQ ID NO: 594474 - DNA, 505 bp, Homo sapiens; identical to SEQ ID NO: 535503
  misc_feature: HIJSMM301BH4NW.8.28.C06.1.454.light.4.raw

SEQ ID NO: 594475 - DNA, 501 bp, Homo sapiens
  misc_feature: HIJSMM301BF7BV.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattcttctggctcgaagtctggcacctcagcctccctggcctgcagtgggctccagtctgaggatgaggctgactattattgtgcagcgtgggatgacggtctgagtgctgtggtcttcggcggagggaccaaggctgaccgtcctgggtcagcccaa

SEQ ID NO: 594476 - DNA, 495 bp, Homo sapiens
  misc_feature: HIJSMM301CT2P3.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgttcagcagtatagtaactggcctccgtacacttttggccaggggaccaagctagaaatcaaacgaactgtggctgcaccatctgtcttcta

SEQ ID NO: 594477 - DNA, 484 bp, Homo sapiens; identical to SEQ ID NO: 535240
  misc_feature: HIJSMM301B7HIU.47.60.F05.1.454.light.4.raw

SEQ ID NO: 594478 - DNA, 499 bp, Homo sapiens; identical to SEQ ID NO: 562406
  misc_feature: HIJSMM301D1Q4O.40.42.D09.1.454.light.4.raw

SEQ ID NO: 594479 - DNA, 472 bp, Homo sapiens
  misc_feature: HIJSMM301BVBUJ.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgatgatcttggaacttattactgccaacaatataatagttattggacgttcggccaggggacgaaggtcgaaatgagacgaactgtgg

SEQ ID NO: 594480 - DNA, 496 bp, Homo sapiens
  misc_feature: HIJSMM301D1FR6.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatacgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 594481 - DNA, 465 bp, Homo sapiens
  misc_feature: HIJSMM301A5JBU.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggtcggagggaccgaagctgaccgtcc

SEQ ID NO: 594482 - DNA, 487 bp, Homo sapiens; identical to SEQ ID NO: 536025
  misc_feature: HIJSMM301AOYPB.17.34.D01.1.454.light.4.raw

SEQ ID NO: 594483 - DNA, 493 bp, Homo sapiens
  misc_feature: HIJSMM301AR3GS.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggacagggtggagatcaaacgaactagtggctgcaccatctgtcttcta

SEQ ID NO: 594484 - DNA, 487 bp, Homo sapiens
  misc_feature: HIJSMM301DQX16.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaaacaatatgatatttattctccagcgttcggccaggggaccaaggtggaagtcaagcgaactgtggctgcaccatct

SEQ ID NO: 594485 - DNA, 508 bp, Homo sapiens; identical to SEQ ID NO: 583220
  misc_feature: HIJSMM301A698E.5.24.C02.1.454.light.4.raw

SEQ ID NO: 594486 - DNA, 490 bp, Homo sapiens; identical to SEQ ID NO: 571829
  misc_feature: HIJSMM301EAGBR.12.88.H11.1.454.light.4.raw

SEQ ID NO: 594487 - DNA, 479 bp, Homo sapiens
  misc_feature: HIJSMM301BZRXR.40.36.D03.1.454.light.4.raw
tctagcgactcacgaccggtgctcgatttagctgcgtcacgatcgtctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattatactactccgctcactttcggcggaggcaccaaggtggagat

SEQ ID NO: 594488 - DNA, 500 bp, Homo sapiens
  misc_feature: HIJSMM301ED2DS.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggcctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagccaaggctgccccctc

SEQ ID NO: 594489 - DNA, 494 bp, Homo sapiens; identical to SEQ ID NO: 534994
  misc_feature: HIJSMM301BXO9N.27.78.H01.1.454.light.4.raw

SEQ ID NO: 594490 - DNA, 490 bp, Homo sapiens; identical to SEQ ID NO: 541567
  misc_feature: HIJSMM301D9XC6.22.65.F10.1.454.light.4.raw

SEQ ID NO: 594491 - DNA, 502 bp, Homo sapiens
  misc_feature: HIJSMM301BL2FP.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactgtggctgcaccatctgtcttcatcttcccgccta

SEQ ID NO: 594492 - DNA, 508 bp, Homo sapiens
  misc_feature: HIJSMM301BULIB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagttttattactgtcaactagttttctcggggcgttcggccgaagggaccgaaggtggaaatcaaacgaactagtggctgcaccatctgtcttcatcttccccg

SEQ ID NO: 594493 - DNA, 521 bp, Homo sapiens; identical to SEQ ID NO: 539470
  misc_feature: HIJSMM301C0NBH.27.23.C01.1.454.light.4.raw

SEQ ID NO: 594494 - DNA, 497 bp, Homo sapiens
  misc_feature: HIJSMM301EN6Y3.51.25.C03.1.454.light.4.raw
cgatcgtatacacgaccggtgctcgatttagtagtgtagatttgggtttggggtgggggcacttctccctctaacactctccccgctcagctcctggggctcctgctactctggctccgaggtgccagatgtgacatccagatgacccagtctccatcctccctgtctgcatctataggagacagagtcacaatcccttgccggtcaagtcaaaacattagcaactatttaaattggtatcaacagaaaccagggaaagcccctaacctcctgatctatgctgcttccactttgcaaagtggggtcccatcgaggttcagtggcagtggatctgggacagatttcagtctcaccatcaccaatctgcgacctgaagattttgcaacttattattgtcaacaggcttacatcacccctctcactttcggcggagggaccaaggtggagatcaaacgaactgtggctgcaccatctgtcttcatcttcccgccatctga

SEQ ID NO: 594495 - DNA, 500 bp, Homo sapiens; identical to SEQ ID NO: 540484
  misc_feature: HIJSMM301DZHBM.48.73.G07.1.454.light.4.raw

SEQ ID NO: 594496 - DNA, 504 bp, Homo sapiens; identical to SEQ ID NO: 535935
  misc_feature: HIJSMM301DWR9H.18.78.H01.1.454.light.4.raw

SEQ ID NO: 594497 - DNA, 504 bp, Homo sapiens
  misc_feature: HIJSMM301DBO9K.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggtgaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacg

SEQ ID NO: 594498 - DNA, 493 bp, Homo sapiens; identical to SEQ ID NO: 537473
  misc_feature: HIJSMM301BK60A.16.6.A06.1.454.light.4.raw

SEQ ID NO: 594499 - DNA, 513 bp, Homo sapiens
  misc_feature: HIJSMM301AXU3C.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggaccgaaggtggaagtacaaacgaactagtggctgcaccactactcgtcttctactcttcccgtccctact

SEQ ID NO: 594500 - DNA, 381 bp, Homo sapiens
  misc_feature: HIJSMM301DJ3VQ.16.78.H01.1.454.light.4.raw
  modified_base (368)..(368): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatcaccaggccactggtatcccagccaggttcagtggcatgggtcctgggacagagttcactctcaaccntacagcagctgca

SEQ ID NO: 594501 - DNA, 509 bp, Homo sapiens
  misc_feature: HIJSMM301BJJZL.43.67.G01.1.454.light.4.raw
  modified_base (501)..(501): a, c, t, g, unknown or other
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatcaaacgaactgtggctgcaccanctgtcttt

SEQ ID NO: 594502 - DNA, 503 bp, Homo sapiens; identical to SEQ ID NO: 549005
  misc_feature: HIJSMM301CEULM.49.82.H05.1.454.light.4.raw

SEQ ID NO: 594503 - DNA, 485 bp, Homo sapiens; identical to SEQ ID NO: 576950
  misc_feature: HIJSMM301AUJE5.40.81.H04.1.454.light.4.raw

SEQ ID NO: 594504 - DNA, 490 bp, Homo sapiens; identical to SEQ ID NO: 538999
  misc_feature: HIJSMM301D69RJ.16.86.H09.1.454.light.4.raw

SEQ ID NO: 594505 - DNA, 494 bp, Homo sapiens
  misc_feature: HIJSMM301BI5K7.43.77.G11.1.454.light.4.raw
tgtgagtagtcacgaccggtgctcgatttagctagtcactcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcta

SEQ ID NO: 594506 - DNA, 512 bp, Homo sapiens
  misc_feature: HIJSMM301DTBW6.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccgaaggtggaggatcaaacgaaactgtggctgcaccatctgtcttcta

SEQ ID NO: 594507 - DNA, 503 bp, Homo sapiens; identical to SEQ ID NO: 535044
  misc_feature: HIJSMM301A9CC8.19.78.H01.1.454.light.4.raw

SEQ ID NO: 594508 - DNA, 484 bp, Homo sapiens
  misc_feature: HIJSMM301EYCVX.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggacaaggtggatatcagacgaa

SEQ ID NO: 594509 - DNA, 490 bp, Homo sapiens; identical to SEQ ID NO: 535234
  misc_feature: HIJSMM301BHDU2.17.21.B10.1.454.light.4.raw

SEQ ID NO: 594510 - DNA, 482 bp, Homo sapiens; identical to SEQ ID NO: 539800
  misc_feature: HIJSMM301CRXMA.21.25.C03.1.454.light.4.raw

SEQ ID NO: 594511 - DNA, 514 bp, Homo sapiens; identical to SEQ ID NO: 547648
  misc_feature: HIJSMM301EMEU5.16.1.A01.1.454.light.4.raw

SEQ ID NO: 594512 - DNA, 472 bp, Homo sapiens; identical to SEQ ID NO: 535898
  misc_feature: HIJSMM301BCVWN.15.8.A08.1.454.light.4.raw

SEQ ID NO: 594513 - DNA, 504 bp, Homo sapiens
  misc_feature: HIJSMM301B25XH.11.57.F02.1.454.light.4.raw
  modified_base (459)..(459): a, c, t, g, unknown or other
  modified_base (462)..(462): a, c, t, g, unknown or other
  modified_base (475)..(475): a, c, t, g, unknown or other
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgtcgcaggacaagtggagtnagngactagtggctgnaccatctgtcttctatcttcccgtccact

SEQ ID NO: 594514 - DNA, 444 bp, Homo sapiens; identical to SEQ ID NO: 534993
  misc_feature: HIJSMM301AVQ2Q.5.9.A09.1.454.light.4.raw

SEQ ID NO: 594515 - DNA, 491 bp, Homo sapiens; identical to SEQ ID NO: 535294
  misc_feature: HIJSMM301D51DO.16.68.G02.1.454.light.4.raw

SEQ ID NO: 594516 - DNA, 523 bp, Homo sapiens
  misc_feature: HIJSMM301CHWW2.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctgttcccgaccct

SEQ ID NO: 594517 - DNA, 376 bp, Homo sapiens
  misc_feature: HIJSMM301BPYQP.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 594518 - DNA, 522 bp, Homo sapiens
  misc_feature: HIJSMM301BM87T.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtctac

SEQ ID NO: 594519 - DNA, 485 bp, Homo sapiens; identical to SEQ ID NO: 536576
  misc_feature: HIJSMM301BJ7VO.46.35.D02.1.454.light.4.raw

SEQ ID NO: 594520 - DNA, 475 bp, Homo sapiens; identical to SEQ ID NO: 569303
  misc_feature: HIJSMM301BX17I.13.76.G10.1.454.light.4.raw
  modified_base (428)..(428): a, c, t, g, unknown or other

SEQ ID NO: 594521 - DNA, 474 bp, Homo sapiens; identical to SEQ ID NO: 561309
  misc_feature: HIJSMM301E0THB.5.12.B01.1.454.light.4.raw

SEQ ID NO: 594522 - DNA, 494 bp, Homo sapiens; identical to SEQ ID NO: 574248
  misc_feature: HIJSMM301A02ZJ.16.6.A06.1.454.light.4.raw

SEQ ID NO: 594523 - DNA, 497 bp, Homo sapiens; identical to SEQ ID NO: 536371
  misc_feature: HIJSMM301B0WVA.16.78.H01.1.454.light.4.raw

SEQ ID NO: 594524 - DNA, 490 bp, Homo sapiens
  misc_feature: HIJSMM301EQBBA.43.13.B02.1.454.light.4.raw
tgtgagtagtcacgaccggtgctcgatttagtctagcgacttccgcggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagccaaggctgcccctcggtcact

SEQ ID NO: 594525 - DNA, 496 bp, Homo sapiens; identical to SEQ ID NO: 535109
  misc_feature: HIJSMM301DZ4DG.16.78.H01.1.454.light.4.raw

SEQ ID NO: 594526 - DNA, 494 bp, Homo sapiens
  misc_feature: HIJSMM301A63X4.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccgaaggtgaccggtcctaggtcagccc

SEQ ID NO: 594527 - DNA, 494 bp, Homo sapiens
  misc_feature: HIJSMM301DNBU0.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaaggccaaccccactgtcactctcg

SEQ ID NO: 594528 - DNA, 501 bp, Homo sapiens; identical to SEQ ID NO: 536142
  misc_feature: HIJSMM301AVMFO.15.1.A01.1.454.light.4.raw

SEQ ID NO: 594529 - DNA, 495 bp, Homo sapiens; identical to SEQ ID NO: 555504
  misc_feature: HIJSMM301CBIP6.51.23.C01.1.454.light.4.raw

SEQ ID NO: 594530 - DNA, 512 bp, Homo sapiens
  misc_feature: HIJSMM301D9BOF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaatacaaacgaactagtggcgtgcaccgatctgtccttctactcttcccccg

SEQ ID NO: 594531 - DNA, 503 bp, Homo sapiens
  misc_feature: HIJSMM301C4NRX.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaaacgaactgtggctgcacatctgtctt

SEQ ID NO: 594532 - DNA, 516 bp, Homo sapiens; identical to SEQ ID NO: 551464
  misc_feature: HIJSMM301BLYR3.17.33.C11.1.454.light.4.raw

SEQ ID NO: 594533 - DNA, 494 bp, Homo sapiens
  misc_feature: HIJSMM301AQ2A5.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggtccaagggaccaaagtaggacgatcaagcgaactgtggctgcaccatctgtt

SEQ ID NO: 594534 - DNA, 505 bp, Homo sapiens; identical to SEQ ID NO: 555744
  misc_feature: HIJSMM301ED6AE.7.71.G05.1.454.light.4.raw

SEQ ID NO: 594535 - DNA, 512 bp, Homo sapiens
  misc_feature: HIJSMM301BDNGJ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttgatggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatt

SEQ ID NO: 594536 - DNA, 512 bp, Homo sapiens
  misc_feature: HIJSMM301ADZUD.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcgcggagggacgaagctgaccgtcttaagtcagcccaaggctgccccctccggtcacctctgttcccta

SEQ ID NO: 594537 - DNA, 499 bp, Homo sapiens
  misc_feature: HIJSMM301EMLQL.19.21.B10.1.454.light.4.raw
tactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccgacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaa

SEQ ID NO: 594538 - DNA, 489 bp, Homo sapiens
  misc_feature: HIJSMM301BUHAL.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcta

SEQ ID NO: 594539 - DNA, 494 bp, Homo sapiens; identical to SEQ ID NO: 534992
  misc_feature: HIJSMM301CXT8J.9.1.A01.1.454.light.4.raw

SEQ ID NO: 594540 - DNA, 498 bp, Homo sapiens
  misc_feature: HIJSMM301EA832.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctgcgacacggcctccctgaccatctctgggctccaggctgaagacgaggctgattattacttgcagctcatatacaggcagcagcactcaggttttcggcggagggaccaagctgaccgtcctaggtcagcccaaggctgccccctccggt

SEQ ID NO: 594541 - DNA, 486 bp, Homo sapiens
  misc_feature: HIJSMM301D80GH.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcaggtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccat

SEQ ID NO: 594542 - DNA, 498 bp, Homo sapiens
  misc_feature: HIJSMM301DCVQE.13.64.F09.1.454.light.4.raw
  modified_base (413)..(413): a, c, t, g, unknown or other
tcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagacctatttgaattggtatcagcaaacaccagggaaagcccccaaatcctgatcttcggttcatctcgtttgcaaagtggagtcccttcacggttcagtggcagtggatctgggacagacttcactctcaccatcggcagtcttcaacgtgacgactttgcaacgtactactgtcaacagaccctanagtacacctcacagttttggccaggggaccaaggtggaagtcaagggaactgtggctgcaccatctgtcttcatcttcccgccat

SEQ ID NO: 594543 - DNA, 486 bp, Homo sapiens
  misc_feature: HIJSMM301AUBOL.17.67.G01.1.454.light.4.raw
cgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtacccccggacgttcggccggagggaccgaggtggaaatacaaacgaactagtggcgtgcacca

SEQ ID NO: 594544 - DNA, 507 bp, Homo sapiens
  misc_feature: HIJSMM301EW2D9.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagccccaaggcccaacccccactgtcacttcc

SEQ ID NO: 594545 - DNA, 493 bp, Homo sapiens; identical to SEQ ID NO: 536246
  misc_feature: HIJSMM301C7WK2.49.66.F11.1.454.light.4.raw

SEQ ID NO: 594546 - DNA, 497 bp, Homo sapiens; identical to SEQ ID NO: 536376
  misc_feature: HIJSMM301CX4TM.22.9.A09.1.454.light.4.raw

SEQ ID NO: 594547 - DNA, 502 bp, Homo sapiens
  misc_feature: HIJSMM301EEFV7.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactcgtcactctgttccccaccctcctccaacgagagta

SEQ ID NO: 594548 - DNA, 480 bp, Homo sapiens; identical to SEQ ID NO: 553480
  misc_feature: HIJSMM301D00CR.21.25.C03.1.454.light.4.raw

SEQ ID NO: 594549 - DNA, 475 bp, Homo sapiens; identical to SEQ ID NO: 550613
  misc_feature: HIJSMM301AK7TU.43.76.G10.1.454.light.4.raw

SEQ ID NO: 594550 - DNA, 503 bp, Homo sapiens; identical to SEQ ID NO: 547049
  misc_feature: HIJSMM301EHBYY.18.59.F04.1.454.light.4.raw

SEQ ID NO: 594551 - DNA, 516 bp, Homo sapiens
  misc_feature: HIJSMM301BMZWB.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcaggcccaaggctgccccctcggtcactctgttcccaccctcctca

SEQ ID NO: 594552 - DNA, 497 bp, Homo sapiens; identical to SEQ ID NO: 536371
  misc_feature: HIJSMM301EJXCR.16.78.H01.1.454.light.4.raw

SEQ ID NO: 594553 - DNA, 486 bp, Homo sapiens; identical to SEQ ID NO: 535917
  misc_feature: HIJSMM301CH3WC.3.10.A10.1.454.light.4.raw

SEQ ID NO: 594554 - DNA, 487 bp, Homo sapiens; identical to SEQ ID NO: 540237
  misc_feature: HIJSMM301B1MNB.47.67.G01.1.454.light.4.raw

SEQ ID NO: 594555 - DNA, 487 bp, Homo sapiens
  misc_feature: HIJSMM301CDDLW.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtgaggctgaagatgtcggggtttattactgcatgcagggtacagtgtggccttcgctcgcattcggcggagggaccaaggtggagatcaaacgaa

SEQ ID NO: 594556 - DNA, 520 bp, Homo sapiens; identical to SEQ ID NO: 558856
  misc_feature: HIJSMM301AKXV9.12.71.G05.1.454.light.4.raw

SEQ ID NO: 594557 - DNA, 501 bp, Homo sapiens
  misc_feature: HIJSMM301BC7UH.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaacgaactagtggctgcaccatatgtcttctatcttccccg

SEQ ID NO: 594558 - DNA, 509 bp, Homo sapiens
  misc_feature: HIJSMM301A8593.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatggcgggggtgttcggcggagggaccaagctgaccgtcctaagtcagcccaaggctgccccctcggtcactctcg

SEQ ID NO: 594559 - DNA, 498 bp, Homo sapiens
  misc_feature: HIJSMM301ECFQT.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaa

SEQ ID NO: 594560 - DNA, 495 bp, Homo sapiens; identical to SEQ ID NO: 593402
  misc_feature: HIJSMM301DUBUF.48.63.F08.1.454.light.4.raw

SEQ ID NO: 594561 - DNA, 490 bp, Homo sapiens; identical to SEQ ID NO: 550493
  misc_feature: HIJSMM301EPR2G.10.59.F04.1.454.light.4.raw

SEQ ID NO: 594562 - DNA, 497 bp, Homo sapiens; identical to SEQ ID NO: 536371
  misc_feature: HIJSMM301EMDFP.16.78.H01.1.454.light.4.raw

SEQ ID NO: 594563 - DNA, 469 bp, Homo sapiens
  misc_feature: HIJSMM301BE9UH.3.68.G02.1.454.light.4.raw
agacgcactccacgaccggtgctcgatttagtcgatagtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgttcaacagagttacagtacccctccgacttttggccagggaccaagctggagatcaaacgaa

SEQ ID NO: 594564 - DNA, 477 bp, Homo sapiens; identical to SEQ ID NO: 537453
  misc_feature: HIJSMM301A4B3G.8.85.H08.1.454.light.4.raw

SEQ ID NO: 594565 - DNA, 521 bp, Homo sapiens
  misc_feature: HIJSMM301EVM17.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctacaaaaagaagtagcctctcgtggttttcggcgggggaccaaggtgaccgtcctaagtcagcccaaggctcgcccctcggtcactctcgttcccgccct

SEQ ID NO: 594566 - DNA, 497 bp, Homo sapiens; identical to SEQ ID NO: 535286
  misc_feature: HIJSMM301DPWOH.18.59.F04.1.454.light.4.raw

SEQ ID NO: 594567 - DNA, 447 bp, Homo sapiens; identical to SEQ ID NO: 535201
  misc_feature: HIJSMM301BBRCZ.18.9.A09.1.454.light.4.raw

SEQ ID NO: 594568 - DNA, 464 bp, Homo sapiens; identical to SEQ ID NO: 536640
  misc_feature: HIJSMM301DQYK1.26.78.H01.1.454.light.4.raw

SEQ ID NO: 594569 - DNA, 473 bp, Homo sapiens; identical to SEQ ID NO: 591271
  misc_feature: HIJSMM301DFZ5Z.51.41.D08.1.454.light.4.raw

SEQ ID NO: 594570 - DNA, 491 bp, Homo sapiens; identical to SEQ ID NO: 535176
  misc_feature: HIJSMM301DOI68.13.39.D06.1.454.light.4.raw

SEQ ID NO: 594571 - DNA, 513 bp, Homo sapiens; identical to SEQ ID NO: 535244
  misc_feature: HIJSMM301DPSEZ.17.33.C11.1.454.light.4.raw

SEQ ID NO: 594572 - DNA, 525 bp, Homo sapiens
  misc_feature: HIJSMM301A9SNY.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccccg

SEQ ID NO: 594573 - DNA, 487 bp, Homo sapiens; identical to SEQ ID NO: 536196
  misc_feature: HIJSMM301BKFIN.11.28.C06.1.454.light.4.raw

SEQ ID NO: 594574 - DNA, 491 bp, Homo sapiens; identical to SEQ ID NO: 535294
  misc_feature: HIJSMM301CNG0U.16.68.G02.1.454.light.4.raw

SEQ ID NO: 594575 - DNA, 501 bp, Homo sapiens
  misc_feature: HIJSMM301CAEZZ.3.34.D01.1.454.light.4.raw
agacgcactccacgaccggtgctcgatttagatcgtctgtgttgggtttgggggaggaactgctcagttaggacccagacggaaccatggaagccccagcgcagcttctcttcctcctgctactctggctcccagataccattggagaaagagtgatgacgcagtctccagccaccctgtctgtgtctccaggggaaagcgccactctctcctgcagggacagtcagactgttagcaccaacttagcctggtatcagcagaaacctggccagtctcccaggctcctcatctatggtgcatccaccagggcccctggtgtcccagtcaggttcagtggcagtgggtctgggacagagttcactctcaccatcagcggcctgcagtctgaagattttgcagtttattactgtcagcagtataattactggccgccgacgttcggccgaaggaccgaaggtgggaaatacaaacgaactagtggcgtgcaccatctgtcttcta

SEQ ID NO: 594576 - DNA, 498 bp, Homo sapiens; identical to SEQ ID NO: 578989
  misc_feature: HIJSMM301BOGTS.43.34.D01.1.454.light.4.raw

SEQ ID NO: 594577 - DNA, 501 bp, Homo sapiens; identical to SEQ ID NO: 588741
  misc_feature: HIJSMM301AZZHW.22.15.B04.1.454.light.4.raw

SEQ ID NO: 594578 - DNA, 495 bp, Homo sapiens
  misc_feature: HIJSMM301DR9DC.41.38.D05.1.454.light.4.raw
tctatactatcacgaccggtgctcgatttagtatctgatagttgggtttggggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcat

SEQ ID NO: 594579 - DNA, 483 bp, Homo sapiens
  misc_feature: HIJSMM301CC0UF.48.23.C01.1.454.light.4.raw
agtatacatacacgaccggtgctcgatttagtacacgtgattagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggttgggttttcggcgggagggaccgaagctgaccgtcctaagtcagcccaac

SEQ ID NO: 594580 - DNA, 515 bp, Homo sapiens; identical to SEQ ID NO: 539211
  misc_feature: HIJSMM301BRX00.22.28.C06.1.454.light.4.raw

SEQ ID NO: 594581 - DNA, 484 bp, Homo sapiens
  misc_feature: HIJSMM301DI5IR.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtgg

SEQ ID NO: 594582 - DNA, 505 bp, Homo sapiens
  misc_feature: HIJSMM301CA0GQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtggaaatcaaacgaactagtggctgcaccatctgtcttcatcttccccg

SEQ ID NO: 594583 - DNA, 493 bp, Homo sapiens
  misc_feature: HIJSMM301CEUBR.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggtcggagggaccgaaggtaggaggagtcaaacgaa

SEQ ID NO: 594584 - DNA, 507 bp, Homo sapiens
  misc_feature: HIJSMM301BND1P.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtaggcactttcgatgtcctattcggcggagggaccaagctgaccgtcctgggtcagcccaaggctgccccctcggtcactctgttcccaccctcctcctacgtcgtat

SEQ ID NO: 594585 - DNA, 514 bp, Homo sapiens
  misc_feature: HIJSMM301CFNW9.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccgaacgggaccgaacggtggaaagtcaaacgaacctagtggctgcgaccatctgtcttctatcttccccg

SEQ ID NO: 594586 - DNA, 482 bp, Homo sapiens
  misc_feature: HIJSMM301D7W7B.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgttggttttggctgttcggcggcgggacc

SEQ ID NO: 594587 - DNA, 504 bp, Homo sapiens
  misc_feature: HIJSMM301DHSC2.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcggggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctggtcactctcg

SEQ ID NO: 594588 - DNA, 491 bp, Homo sapiens
  misc_feature: HIJSMM301EIBEO.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgcctacttttggccaggggaccaaggctggagatcaggcgtaacg

SEQ ID NO: 594589 - DNA, 509 bp, Homo sapiens; identical to SEQ ID NO: 536047
  misc_feature: HIJSMM301C4SGR.17.33.C11.1.454.light.4.raw

SEQ ID NO: 594590 - DNA, 510 bp, Homo sapiens; identical to SEQ ID NO: 566642
  misc_feature: HIJSMM301AOB75.17.28.C06.1.454.light.4.raw

SEQ ID NO: 594591 - DNA, 503 bp, Homo sapiens
  misc_feature: HIJSMM301AHM5K.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttggccaagggaccaacggtggaaatacaaacgaacagtggctgcaccatctgtcttcatcttccccg

SEQ ID NO: 594592 - DNA, 475 bp, Homo sapiens
  misc_feature: HIJSMM301D352X.48.37.D04.1.454.light.4.raw
agtatacatacacgaccggtgctcgatttagtagcatactgttgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 594593 - DNA, 488 bp, Homo sapiens; identical to SEQ ID NO: 538291
  misc_feature: HIJSMM301DEOAL.19.71.G05.1.454.light.4.raw

SEQ ID NO: 594594 - DNA, 504 bp, Homo sapiens; identical to SEQ ID NO: 538940
  misc_feature: HIJSMM301C5YZV.2.35.D02.1.454.light.4.raw

SEQ ID NO: 594595 - DNA, 485 bp, Homo sapiens
  misc_feature: HIJSMM301BQ2ZP.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattctatcgggtgttcggcggagggaccaagctgaccgtcctaggtcagcccaaggctgccccctcggtcta

SEQ ID NO: 594596 - DNA, 501 bp, Homo sapiens
  misc_feature: HIJSMM301AZNY7.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcggcggagggaccgaaggtggagatcaaacgaactgtggctgcaccta

SEQ ID NO: 594597 - DNA, 496 bp, Homo sapiens
  misc_feature: HIJSMM301D6PW5.18.59.F04.1.454.light.4.raw
tacgagtatgcacgaccggtgctcgatttagtacacacacttagagattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaac

SEQ ID NO: 594598 - DNA, 476 bp, Homo sapiens; identical to SEQ ID NO: 538611
  misc_feature: HIJSMM301EOAII.7.81.H04.1.454.light.4.raw

SEQ ID NO: 594599 - DNA, 508 bp, Homo sapiens
  misc_feature: HIJSMM301CHLVW.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggcccaaccccactgtca

SEQ ID NO: 594600 - DNA, 488 bp, Homo sapiens
  misc_feature: HIJSMM301BTACA.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcatcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagacgaactgtggctgcaccat

SEQ ID NO: 594601 - DNA, 490 bp, Homo sapiens; identical to SEQ ID NO: 579622
  misc_feature: HIJSMM301CJ2U5.16.68.G02.1.454.light.4.raw

SEQ ID NO: 594602 - DNA, 521 bp, Homo sapiens; identical to SEQ ID NO: 539470
  misc_feature: HIJSMM301DYJ3S.27.23.C01.1.454.light.4.raw

SEQ ID NO: 594603 - DNA, 502 bp, Homo sapiens
  misc_feature: HIJSMM301AGAVE.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcact

SEQ ID NO: 594604 - DNA, 484 bp, Homo sapiens
  misc_feature: HIJSMM301BK9G7.40.84.H07.1.454.light.4.raw
tctagcgactcacgaccggtgctcgatttagcagacgtctgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacg

SEQ ID NO: 594605 - DNA, 480 bp, Homo sapiens; identical to SEQ ID NO: 557442
  misc_feature: HIJSMM301AS1JX.8.53.E09.1.454.light.4.raw

SEQ ID NO: 594606 - DNA, 473 bp, Homo sapiens
  misc_feature: HIJSMM301BL6HZ.48.61.F06.1.454.light.4.raw
  modified_base (441)..(441): a, c, t, g, unknown or other
agtatacatacacgaccggtgctcgatttagctacgctctaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctcctgaccatctctgggctccaggctgaggatgaggctgattattactgctgctcatatgcaggcagctacnctttggtgttcggcggagggaccaagctgact

SEQ ID NO: 594607 - DNA, 498 bp, Homo sapiens
  misc_feature: HIJSMM301EGXEQ.51.71.G05.1.454.light.4.raw
  modified_base (435)..(435): a, c, t, g, unknown or other
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacaagacaccattggtacttatntcttcggaactgcgaccaaggtcaccgtcctggtcgagcccaaggccaacccaacctgtcact

SEQ ID NO: 594608 - DNA, 479 bp, Homo sapiens; identical to SEQ ID NO: 535188
  misc_feature: HIJSMM301CESC9.10.74.G08.1.454.light.4.raw

SEQ ID NO: 594609 - DNA, 503 bp, Homo sapiens; identical to SEQ ID NO: 537189
  misc_feature: HIJSMM301AXTB1.19.85.H08.1.454.light.4.raw

SEQ ID NO: 594610 - DNA, 494 bp, Homo sapiens; identical to SEQ ID NO: 535478
  misc_feature: HIJSMM301CWVLI.10.79.H02.1.454.light.4.raw

SEQ ID NO: 594611 - DNA, 505 bp, Homo sapiens
  misc_feature: HIJSMM301B0N1B.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggcctgccccctcggt

SEQ ID NO: 594612 - DNA, 468 bp, Homo sapiens
  misc_feature: HIJSMM301COIZQ.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataaccg

SEQ ID NO: 594613 - DNA, 507 bp, Homo sapiens; identical to SEQ ID NO: 588234
  misc_feature: HIJSMM301A6JC6.19.78.H01.1.454.light.4.raw

SEQ ID NO: 594614 - DNA, 515 bp, Homo sapiens
  misc_feature: HIJSMM301A6T6Q.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactcc

SEQ ID NO: 594615 - DNA, 495 bp, Homo sapiens
  misc_feature: HIJSMM301DTHWL.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacgaccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 594616 - DNA, 505 bp, Homo sapiens
  misc_feature: HIJSMM301DBFW2.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcacgt

SEQ ID NO: 594617 - DNA, 480 bp, Homo sapiens; identical to SEQ ID NO: 555208
  misc_feature: HIJSMM301EJSRF.21.25.C03.1.454.light.4.raw

SEQ ID NO: 594618 - DNA, 472 bp, Homo sapiens; identical to SEQ ID NO: 535898
  misc_feature: HIJSMM301EGYSE.15.8.A08.1.454.light.4.raw

SEQ ID NO: 594619 - DNA, 505 bp, Homo sapiens
  misc_feature: HIJSMM301DNIYH.48.71.G05.1.454.light.4.raw
agtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttccg

SEQ ID NO: 594620 - DNA, 484 bp, Homo sapiens; identical to SEQ ID NO: 535441
  misc_feature: HIJSMM301DX6WK.26.60.F05.1.454.light.4.raw

SEQ ID NO: 594621 - DNA, 494 bp, Homo sapiens
  misc_feature: HIJSMM301C0L70.10.79.H02.1.454.light.4.raw
  modified_base (483)..(483): a, c, t, g, unknown or other
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccgaggggaccaagctggagatcaaacgaactgtggctgcnccatctgtctt

SEQ ID NO: 594622 - DNA, 518 bp, Homo sapiens
  misc_feature: HIJSMM301ATONF.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcgggagggaccaagctgaccgtcttaagtcagcccaaggctgccccctccggtcactctgttccccaccctccct

SEQ ID NO: 594623 - DNA, 551 bp, Homo sapiens
  misc_feature: HIJSMM301BC0FO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgacggacgtgaccgtacccgttacggtccgtagcccaacggacgtcgcccccgtcccggtccgtacctcctcgtttcccgtccccctt

SEQ ID NO: 594624 - DNA, 486 bp, Homo sapiens
  misc_feature: HIJSMM301AY1OJ.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgatttattattgtgcaacatgggatagtagcctgagtagtgtggttttcggcggagggaccaaaactgaccgtcctaggtcagcccaaggctgccccctggtcactctgttcccaccctcctctacgtgagct

SEQ ID NO: 594625 - DNA, 506 bp, Homo sapiens
  misc_feature: HIJSMM301DQIYP.19.72.G06.1.454.light.4.raw
tactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggccgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctggtcact

SEQ ID NO: 594626 - DNA, 503 bp, Homo sapiens; identical to SEQ ID NO: 536834
  misc_feature: HIJSMM301ETKGK.2.35.D02.1.454.light.4.raw

SEQ ID NO: 594627 - DNA, 467 bp, Homo sapiens
  misc_feature: HIJSMM301BZ4DX.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 594628 - DNA, 476 bp, Homo sapiens
  misc_feature: HIJSMM301D3MGH.52.40.D07.1.454.light.4.raw
cgcagtacgacacgaccggtgctcgatttagtgatagagcgtaacaacagaggggagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagacgtggggtcccatcaaggttcagcggcagtggatctgggagacaattcactctcacaatcagcagcctgcagcctgaagattttgcgacttattactgtcaacaacttaatcgttaccctcttttcggccctgggaccaagtggatatcaaacgaactgtggctgcacc

SEQ ID NO: 594629 - DNA, 494 bp, Homo sapiens; identical to SEQ ID NO: 534994
  misc_feature: HIJSMM301AM4GW.27.78.H01.1.454.light.4.raw

SEQ ID NO: 594630 - DNA, 482 bp, Homo sapiens
  misc_feature: HIJSMM301AXQLZ.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaagaa

SEQ ID NO: 594631 - DNA, 501 bp, Homo sapiens; identical to SEQ ID NO: 536142
  misc_feature: HIJSMM301A74O6.15.1.A01.1.454.light.4.raw

SEQ ID NO: 594632 - DNA, 521 bp, Homo sapiens
  misc_feature: HIJSMM301END08.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaatttttgacctagtctcctggtaccaacaatacccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcggaccgaagtgaccgtcctaagtcagccaagctcgccccctccggtcactatgttcccgccctt

SEQ ID NO: 594633 - DNA, 523 bp, Homo sapiens
  misc_feature: HIJSMM301BY1PW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacgaaacgaacgtaacgtggcgtgcaccactctgtcttctatcttcccgccctact

SEQ ID NO: 594634 - DNA, 514 bp, Homo sapiens
  misc_feature: HIJSMM301DD521.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctcgttcccaccct

SEQ ID NO: 594635 - DNA, 499 bp, Homo sapiens
  misc_feature: HIJSMM301AFO59.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgaccctcctccgagtagtaca

SEQ ID NO: 594636 - DNA, 477 bp, Homo sapiens
  misc_feature: HIJSMM301EBQEI.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatacaaacgaactgtggctgcacc

SEQ ID NO: 594637 - DNA, 519 bp, Homo sapiens
  misc_feature: HIJSMM301DLTV3.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccaatggttgcaccgcaaagcggggacccagaccctggagcctcagttggaagcagccgatccagcctgcggagcctgtggggcaggtcagcccaaggctcgccccctcggtcactctcgttcccgccctcctccacg

SEQ ID NO: 594638 - DNA, 477 bp, Homo sapiens
  misc_feature: HIJSMM301DHJ4D.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatctaccagtctgcaggctgaggattttgcaacttacttctgtcaacagagttacagttccctcactttcggccctgggaccatagtggatatcaacgaactgtggctgcaccatctgtctt

SEQ ID NO: 594639 - DNA, 500 bp, Homo sapiens; identical to SEQ ID NO: 563210
  misc_feature: HIJSMM301D2A5J.41.18.B07.1.454.light.4.raw

SEQ ID NO: 594640 - DNA, 492 bp, Homo sapiens
  misc_feature: HIJSMM301BEKRV.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccggtcctaggtcagcccaaggccaaccccactcg

SEQ ID NO: 594641 - DNA, 499 bp, Homo sapiens
  misc_feature: HIJSMM301DYHBB.40.11.A11.1.454.light.4.raw
tctagcgactcacgaccggtgctcgatttagctacgactgcagggagggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgacccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactcgtggctgcaccatctgtcttcatcttccgccact

SEQ ID NO: 594642 - DNA, 522 bp, Homo sapiens
  misc_feature: HIJSMM301DWAA4.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttaattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgattaatttctgggttgttcggcgggaagggaccaaaactgaccggtcctaggttacacggcccaaggcctcggccccctacggtcacctt

SEQ ID NO: 594643 - DNA, 502 bp, Homo sapiens
  misc_feature: HIJSMM301BRN1D.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaaacgaactgtggctgcaccatctgtcttcatcttcccgccat

SEQ ID NO: 594644 - DNA, 494 bp, Homo sapiens
  misc_feature: HIJSMM301DXI5V.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcagtgatcaccttcggccaagggacacgactggagattaaacgaactagtggctgcaccatctgtctt

SEQ ID NO: 594645 - DNA, 493 bp, Homo sapiens
  misc_feature: HIJSMM301CWOUV.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaacgaactgtggctgcaccatctgtctcta

SEQ ID NO: 594646 - DNA, 508 bp, Homo sapiens
  misc_feature: HIJSMM301AQ8AC.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctggtcactctgtt

SEQ ID NO: 594647 - DNA, 512 bp, Homo sapiens
  misc_feature: HIJSMM301DGWTQ.12.53.E09.1.454.light.4.raw
atacgacgtacacgaccggtgctcgatttagagagagtgtgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctggtcagcccaaggctgccccctcggtcta

SEQ ID NO: 594648 - DNA, 469 bp, Homo sapiens
  misc_feature: HIJSMM301A8F89.49.37.D04.1.454.light.4.raw
agtcgagagacacgaccggtgctcgatttagtagcatactgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgttacacttttggccagggaccaggctggatatcagacgaa

SEQ ID NO: 594649 - DNA, 447 bp, Homo sapiens; identical to SEQ ID NO: 535020
  misc_feature: HIJSMM301CEKER.18.9.A09.1.454.light.4.raw

SEQ ID NO: 594650 - DNA, 493 bp, Homo sapiens; identical to SEQ ID NO: 542591
  misc_feature: HIJSMM301B1VMC.9.1.A01.1.454.light.4.raw

SEQ ID NO: 594651 - DNA, 502 bp, Homo sapiens; identical to SEQ ID NO: 546688
  misc_feature: HIJSMM301BPYQX.41.26.C04.1.454.light.4.raw

SEQ ID NO: 594652 - DNA, 484 bp, Homo sapiens
  misc_feature: HIJSMM301C5WBZ.48.27.C05.1.454.light.4.raw
agtatacatacacgaccggtgctcgatttagacgcgatcgaagggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttggtgtttggcggaggaccaagctgaccgtcctaggtcag

SEQ ID NO: 594653 - DNA, 487 bp, Homo sapiens; identical to SEQ ID NO: 560173
  misc_feature: HIJSMM301AU6X9.47.70.G04.1.454.light.4.raw

SEQ ID NO: 594654 - DNA, 496 bp, Homo sapiens
  misc_feature: HIJSMM301CZSBQ.43.71.G05.1.454.light.4.raw
tgtgagtagtcacgaccggtgctcgatttagtgtcgtcgcaagagagaggggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 594655 - DNA, 447 bp, Homo sapiens; identical to SEQ ID NO: 535201
  misc_feature: HIJSMM301BIDMQ.18.9.A09.1.454.light.4.raw

SEQ ID NO: 594656 - DNA, 491 bp, Homo sapiens; identical to SEQ ID NO: 535194
  misc_feature: HIJSMM301BTFTU.26.78.H01.1.454.light.4.raw

SEQ ID NO: 594657 - DNA, 492 bp, Homo sapiens; identical to SEQ ID NO: 534967
  misc_feature: HIJSMM301C2F96.47.64.F09.1.454.light.4.raw

SEQ ID NO: 594658 - DNA, 513 bp, Homo sapiens; identical to SEQ ID NO: 559106
  misc_feature: HIJSMM301BVBLE.11.57.F02.1.454.light.4.raw

SEQ ID NO: 594659 - DNA, 470 bp, Homo sapiens; identical to SEQ ID NO: 535009
  misc_feature: HIJSMM301CVQDR.18.76.G10.1.454.light.4.raw

SEQ ID NO: 594660 - DNA, 494 bp, Homo sapiens; identical to SEQ ID NO: 534994
  misc_feature: HIJSMM301EFCKN.27.78.H01.1.454.light.4.raw

SEQ ID NO: 594661 - DNA, 495 bp, Homo sapiens
  misc_feature: HIJSMM301B7WEL.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagcccaaggctgcccctcggtcactctcg

SEQ ID NO: 594662 - DNA, 485 bp, Homo sapiens; identical to SEQ ID NO: 556203
  misc_feature: HIJSMM301DSSBJ.49.34.D01.1.454.light.4.raw

SEQ ID NO: 594663 - DNA, 503 bp, Homo sapiens
  misc_feature: HIJSMM301DXXAD.21.22.B11.1.454.light.4.raw
  modified_base (415)..(415): a, c, t, g, unknown or other
  modified_base (430)..(430): a, c, t, g, unknown or other
  modified_base (462)..(462): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatccagtgggctccggtccgaggatgaggctgactattacngtgcatcaacgggcncaacatgggatgacaatctgagcggttgggtnttcggcggagggaccaaactgaccgtcctaggtcagcccaa

SEQ ID NO: 594664 - DNA, 484 bp, Homo sapiens; identical to SEQ ID NO: 535400
  misc_feature: HIJSMM301C73DM.46.26.C04.1.454.light.4.raw

SEQ ID NO: 594665 - DNA, 467 bp, Homo sapiens; identical to SEQ ID NO: 535997
  misc_feature: HIJSMM301ERVSS.5.36.D03.1.454.light.4.raw

SEQ ID NO: 594666 - DNA, 507 bp, Homo sapiens
  misc_feature: HIJSMM301DLN89.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattacttgcatgcaaactacacacggccgctcactttcggcggagggaccgaaggtggagaatcaaacgaaactgtggctgcaccatct

SEQ ID NO: 594667 - DNA, 503 bp, Homo sapiens
  misc_feature: HIJSMM301C915T.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtctaggtcagcccaaggctgccccctcggtcta

SEQ ID NO: 594668 - DNA, 491 bp, Homo sapiens
  misc_feature: HIJSMM301AN20E.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaatcaaacgaactgtggctgcaccatctgtcttc

SEQ ID NO: 594669 - DNA, 506 bp, Homo sapiens
  misc_feature: HIJSMM301CM2YR.15.1.A01.1.454.light.4.raw
tctacgtagccacgaccggtgctcgatttagacgtctcatcaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacggtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctcg

SEQ ID NO: 594670 - DNA, 536 bp, Homo sapiens
  misc_feature: HIJSMM301CLQNT.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggcccctcactttcggtccggggggaccggaacggtagggaggttacgtaaacgaaaccgtagttggcgttcgcgaccaactcttgtctttcctatccttcccgtcccta

SEQ ID NO: 594671 - DNA, 501 bp, Homo sapiens; identical to SEQ ID NO: 536142
  misc_feature: HIJSMM301DOCO7.15.1.A01.1.454.light.4.raw

SEQ ID NO: 594672 - DNA, 505 bp, Homo sapiens
  misc_feature: HIJSMM301DUL5D.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccaaggtggaaatacaaacgaactagtggctgcaccatctgtcttctatcttccccg

SEQ ID NO: 594673 - DNA, 495 bp, Homo sapiens; identical to SEQ ID NO: 537273
  misc_feature: HIJSMM301BLHCO.15.26.C04.1.454.light.4.raw

SEQ ID NO: 594674 - DNA, 486 bp, Homo sapiens
  misc_feature: HIJSMM301BP3QQ.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttcggcggacgggaccacagtcgagatacaaacgaactgtggctgcaccat

SEQ ID NO: 594675 - DNA, 509 bp, Homo sapiens
  misc_feature: HIJSMM301CGG24.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctcctgacaatctctggctccagctgacgacgaggctgaatattactgcagctcatatgtagatggtgccttctttctaaggttttcggcgggacgggaccgaggctgaccgtcctaagtcacgccaaggctcgccccctcggt

SEQ ID NO: 594676 - DNA, 492 bp, Homo sapiens; identical to SEQ ID NO: 557028
  misc_feature: HIJSMM301EYDE4.51.6.A06.1.454.light.4.raw

SEQ ID NO: 594677 - DNA, 482 bp, Homo sapiens
  misc_feature: HIJSMM301C478F.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggccg

SEQ ID NO: 594678 - DNA, 433 bp, Homo sapiens
  misc_feature: HIJSMM301C9FF5.10.38.D05.1.454.light.4.raw
catagtagtgcacgaccggtgctcgatttagtatctgatagttgggtttggggggtgtggtggtctccactccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctcggtcactctgttcccgccctcctccactactatg

SEQ ID NO: 594679 - DNA, 511 bp, Homo sapiens; identical to SEQ ID NO: 555746
  misc_feature: HIJSMM301A846T.17.33.C11.1.454.light.4.raw

SEQ ID NO: 594680 - DNA, 505 bp, Homo sapiens
  misc_feature: HIJSMM301C5G1P.41.26.C04.1.454.light.4.raw
tctatactatcacgaccggtgctcgatttagtctagcgactttgggtttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 594681 - DNA, 487 bp, Homo sapiens
  misc_feature: HIJSMM301ARB8W.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctcgttcccaccctcctctaccgtgagct

SEQ ID NO: 594682 - DNA, 516 bp, Homo sapiens; identical to SEQ ID NO: 587354
  misc_feature: HIJSMM301AKHG2.41.73.G07.1.454.light.4.raw

SEQ ID NO: 594683 - DNA, 496 bp, Homo sapiens
  misc_feature: HIJSMM301B5VF0.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggagatcaaccgaactgtggctgcaccatctgtt

SEQ ID NO: 594684 - DNA, 521 bp, Homo sapiens; identical to SEQ ID NO: 539470
  misc_feature: HIJSMM301EM4I1.27.23.C01.1.454.light.4.raw

SEQ ID NO: 594685 - DNA, 495 bp, Homo sapiens; identical to SEQ ID NO: 549785
  misc_feature: HIJSMM301B37MU.12.38.D05.1.454.light.4.raw

SEQ ID NO: 594686 - DNA, 498 bp, Homo sapiens; identical to SEQ ID NO: 561081
  misc_feature: HIJSMM301CE81Z.15.81.H04.1.454.light.4.raw

SEQ ID NO: 594687 - DNA, 502 bp, Homo sapiens
  misc_feature: HIJSMM301BXORN.10.50.E06.1.454.light.4.raw
catagtagtgcacgaccggtgctcgatttagatctactgacaacacacaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcataattcatgatgtcaataatcggccctcaggggtttctaatcgcttctctggcttcaagtctggcaacacggcctccctgaccatctctgggctccaggctgaggacgaggctgattattactgcagctcatatacaaccagcagcactcgggtgttcggcggagggaccaagctgaccgtcctaggtcagcccaaggctgcccccc

SEQ ID NO: 594688 - DNA, 485 bp, Homo sapiens; identical to SEQ ID NO: 536582
  misc_feature: HIJSMM301AP7J2.3.46.E02.1.454.light.4.raw

SEQ ID NO: 594689 - DNA, 496 bp, Homo sapiens; identical to SEQ ID NO: 536802
  misc_feature: HIJSMM301EDOBY.5.24.C02.1.454.light.4.raw

SEQ ID NO: 594690 - DNA, 484 bp, Homo sapiens
  misc_feature: HIJSMM301AVIIV.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgt

SEQ ID NO: 594691 - DNA, 480 bp, Homo sapiens
  misc_feature: HIJSMM301DOE28.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtcgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtggacatcagcagtgaggtggttttcggcggagggaccaagctgaccgtcctaagtcagaccccg

SEQ ID NO: 594692 - DNA, 486 bp, Homo sapiens
  misc_feature: HIJSMM301AN3LR.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgcagggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccgaaggtggagatcaaacgaactgtggctgcacc

SEQ ID NO: 594693 - DNA, 502 bp, Homo sapiens; identical to SEQ ID NO: 539314
  misc_feature: HIJSMM301EMD7Q.21.81.H04.1.454.light.4.raw

SEQ ID NO: 594694 - DNA, 495 bp, Homo sapiens
  misc_feature: HIJSMM301EEYK0.48.79.H02.1.454.light.4.raw
agtatacatacacgaccggtgctcgatttagtgtcacacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccgatacgaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgagatgtggcagtttattactgtcagcaatattatactactccgtggactttcggccaaggaccaaggtggaaatcagacgaactgtggctgcaccat

SEQ ID NO: 594695 - DNA, 491 bp, Homo sapiens
  misc_feature: HIJSMM301CGMO4.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggatgttggggtttattactgcatgcaaagtatacagcttccgtacacttttggccaggggaccaagctggagatcaaacgaactgt

SEQ ID NO: 594696 - DNA, 491 bp, Homo sapiens; identical to SEQ ID NO: 535294
  misc_feature: HIJSMM301EV632.16.68.G02.1.454.light.4.raw

SEQ ID NO: 594697 - DNA, 520 bp, Homo sapiens
  misc_feature: HIJSMM301EZ6WF.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtccaggtcagcccaaggctgccccctcggtcactctgttcccgccct

SEQ ID NO: 594698 - DNA, 489 bp, Homo sapiens
  misc_feature: HIJSMM301CST0L.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctgaacgttggccaggaccacagtggatatcaggcgaactgtggctgcaccatctgtctt

SEQ ID NO: 594699 - DNA, 507 bp, Homo sapiens
  misc_feature: HIJSMM301E1HU7.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctacagtacgttccgaccgaacgggaccaaggtaggaatacaaacgaactgtggctgaccacta

SEQ ID NO: 594700 - DNA, 460 bp, Homo sapiens
  misc_feature: HIJSMM301DE2WN.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccaggggaccgacggtggatgtcagcgaactgtggctgcaccatctgtcttctatcttccgccatctgaactactcaca

SEQ ID NO: 594701 - DNA, 506 bp, Homo sapiens
  misc_feature: HIJSMM301AKPNW.15.86.H09.1.454.light.4.raw
  modified_base (468)..(468): a, c, t, g, unknown or other
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacgggatccccgatcgcttcatgggctccagttctggggctgaccgctacctcaccatctccaacctccagtctgacgatgaggctgagtatcactgtggagagagccacacaattgatggccaagacggttgggngttcggcggagggaccaagctgaccgtcctaggtcacg

SEQ ID NO: 594702 - DNA, 505 bp, Homo sapiens; identical to SEQ ID NO: 535503
  misc_feature: HIJSMM301AZ1PU.8.28.C06.1.454.light.4.raw

SEQ ID NO: 594703 - DNA, 491 bp, Homo sapiens
  misc_feature: HIJSMM301C9LLP.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgctagtttattactgtcagcaatataacaagtggccattcactttcggcccagggaccaaagtggatatcaaacgaactgtggctgcaccatctgtcttcatt

SEQ ID NO: 594704 - DNA, 496 bp, Homo sapiens; identical to SEQ ID NO: 566097
  misc_feature: HIJSMM301CBIN8.5.12.B01.1.454.light.4.raw

SEQ ID NO: 594705 - DNA, 508 bp, Homo sapiens; identical to SEQ ID NO: 553356
  misc_feature: HIJSMM301C273E.3.79.H02.1.454.light.4.raw

SEQ ID NO: 594706 - DNA, 519 bp, Homo sapiens
  misc_feature: HIJSMM301EOQSF.22.30.C08.1.454.light.4.raw
  modified_base (501)..(501): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctgggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactcngttcccaccctcctcacg

SEQ ID NO: 594707 - DNA, 486 bp, Homo sapiens; identical to SEQ ID NO: 593874
  misc_feature: HIJSMM301AYNYK.47.78.H01.1.454.light.4.raw

SEQ ID NO: 594708 - DNA, 503 bp, Homo sapiens; identical to SEQ ID NO: 536834
  misc_feature: HIJSMM301BCM20.2.35.D02.1.454.light.4.raw

SEQ ID NO: 594709 - DNA, 505 bp, Homo sapiens
  misc_feature: HIJSMM301C06BB.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctggaggacgaggctgatttattactgcagctcatatacaagcagcagcactctcgtggtattcgggcggagggaccaagctgaccgtcctaggtcacgcccaaggctcccg

SEQ ID NO: 594710 - DNA, 496 bp, Homo sapiens
  misc_feature: HIJSMM301DDV3U.52.54.E10.1.454.light.4.raw
cgcagtacgacacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccctac

SEQ ID NO: 594711 - DNA, 509 bp, Homo sapiens; identical to SEQ ID NO: 539359
  misc_feature: HIJSMM301AUFKT.47.85.H08.1.454.light.4.raw

SEQ ID NO: 594712 - DNA, 496 bp, Homo sapiens
  misc_feature: HIJSMM301BZHNQ.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtcactctcg

SEQ ID NO: 594713 - DNA, 505 bp, Homo sapiens
  misc_feature: HIJSMM301ELKXI.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactcgaccgtcctaggtcacgcccaaggctcgccccctc

SEQ ID NO: 594714 - DNA, 456 bp, Homo sapiens
  misc_feature: HIJSMM301AUHDK.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctaggaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 594715 - DNA, 524 bp, Homo sapiens
  misc_feature: HIJSMM301DU8SC.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccaccct

SEQ ID NO: 594716 - DNA, 493 bp, Homo sapiens
  misc_feature: HIJSMM301E1T2W.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtactttcgggttttcgcggagggaccaagctgacgtcctaggtcagcccaaggctgcccccg

SEQ ID NO: 594717 - DNA, 472 bp, Homo sapiens; identical to SEQ ID NO: 535898
  misc_feature: HIJSMM301AVZHZ.15.8.A08.1.454.light.4.raw

SEQ ID NO: 594718 - DNA, 496 bp, Homo sapiens; identical to SEQ ID NO: 548004
  misc_feature: HIJSMM301CB81D.3.35.D02.1.454.light.4.raw

SEQ ID NO: 594719 - DNA, 499 bp, Homo sapiens
  misc_feature: HIJSMM301E1PDR.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggcccgtggacgttcggccaagggaccaaggtggaaatcaaacgaactgtggctgcacc

SEQ ID NO: 594720 - DNA, 499 bp, Homo sapiens
  misc_feature: HIJSMM301DAG0D.48.31.C09.1.454.light.4.raw
agtatacatacacgaccggtgctcgatttagacgtctcatcaaggaaggaaggggcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttcccg

SEQ ID NO: 594721 - DNA, 505 bp, Homo sapiens
  misc_feature: HIJSMM301BSG5T.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctggtca

SEQ ID NO: 594722 - DNA, 389 bp, Homo sapiens; identical to SEQ ID NO: 558170
  misc_feature: HIJSMM301C2BGL.21.40.D07.1.454.light.4.raw

SEQ ID NO: 594723 - DNA, 503 bp, Homo sapiens
  misc_feature: HIJSMM301CGU0H.48.30.C08.1.454.light.4.raw
  modified_base (454)..(454): a, c, t, g, unknown or other
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggacccgtcgtcgacggagacgacngagataagtaactagtgcgtgcacactctcgttcttctcttctcccgtt

SEQ ID NO: 594724 - DNA, 521 bp, Homo sapiens; identical to SEQ ID NO: 539470
  misc_feature: HIJSMM301CTA2H.27.23.C01.1.454.light.4.raw

SEQ ID NO: 594725 - DNA, 513 bp, Homo sapiens
  misc_feature: HIJSMM301BJWL4.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccgaacatagaagtacaaacgaacctagtggcgtgcgaccactctgtcttcta

SEQ ID NO: 594726 - DNA, 484 bp, Homo sapiens; identical to SEQ ID NO: 535400
  misc_feature: HIJSMM301B3PA4.46.26.C04.1.454.light.4.raw

SEQ ID NO: 594727 - DNA, 523 bp, Homo sapiens
  misc_feature: HIJSMM301ALAP1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggtcggagggaccaggctgaccgtcctaggtcagccaacggctgccccctcggtcactctgttcccaccct

SEQ ID NO: 594728 - DNA, 485 bp, Homo sapiens; identical to SEQ ID NO: 538787
  misc_feature: HIJSMM301CJIUB.49.57.F02.1.454.light.4.raw

SEQ ID NO: 594729 - DNA, 500 bp, Homo sapiens
  misc_feature: HIJSMM301BAT5V.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtctaggtcagcccaaggccaacccactgtca

SEQ ID NO: 594730 - DNA, 488 bp, Homo sapiens; identical to SEQ ID NO: 535568
  misc_feature: HIJSMM301C75DY.21.4.A04.1.454.light.4.raw

SEQ ID NO: 594731 - DNA, 478 bp, Homo sapiens; identical to SEQ ID NO: 535129
  misc_feature: HIJSMM301EZH0F.11.11.A11.1.454.light.4.raw

SEQ ID NO: 594732 - DNA, 493 bp, Homo sapiens; identical to SEQ ID NO: 538503
  misc_feature: HIJSMM301DT47T.9.1.A01.1.454.light.4.raw

SEQ ID NO: 594733 - DNA, 506 bp, Homo sapiens
  misc_feature: HIJSMM301EH6BB.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggcccaggcagatgatgagtgtgattattactgtgtgctctatatgggcaggtggcgtttgggtgttcggcggagggaccaagctgaccgtcg

SEQ ID NO: 594734 - DNA, 485 bp, Homo sapiens
  misc_feature: HIJSMM301EOOB8.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccagggtggaggatcagacgaa

SEQ ID NO: 594735 - DNA, 483 bp, Homo sapiens
  misc_feature: HIJSMM301DU0YU.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtcaacagcttaatagttacccgctcagtttcggcggagggaccaaggtggagatcaaacgaactgtggctgcaccatctgtcttcta

SEQ ID NO: 594736 - DNA, 488 bp, Homo sapiens; identical to SEQ ID NO: 535990
  misc_feature: HIJSMM301A36CN.11.28.C06.1.454.light.4.raw

SEQ ID NO: 594737 - DNA, 495 bp, Homo sapiens; identical to SEQ ID NO: 538434
  misc_feature: HIJSMM301CPCIX.51.81.H04.1.454.light.4.raw

SEQ ID NO: 594738 - DNA, 519 bp, Homo sapiens
  misc_feature: HIJSMM301BB2WL.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccgaagctgaccgtcctaggtcagcccaaggctgccccctcggtcactcc

SEQ ID NO: 594739 - DNA, 512 bp, Homo sapiens
  misc_feature: HIJSMM301CS2E1.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcaggtgggtctgggacagacttcactctcaccatcagcagcctggagcctgaagattattgctagtttattattgtcagcagcgtagcaggtggcctttcactttcggcccggggaccaaagtaggaaatacaaacgaactgtggctgcaccatctgtcttcatcttcccgcc

SEQ ID NO: 594740 - DNA, 477 bp, Homo sapiens
  misc_feature: HIJSMM301B58VY.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccaggtgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactagtggctgcacc

SEQ ID NO: 594741 - DNA, 501 bp, Homo sapiens
  misc_feature: HIJSMM301D90IP.4.10.A10.1.454.light.4.raw
agcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccatcctgggtcagcccaaggctgccccctcggtcactctgt

SEQ ID NO: 594742 - DNA, 520 bp, Homo sapiens; identical to SEQ ID NO: 537173
  misc_feature: HIJSMM301C0DP6.27.23.C01.1.454.light.4.raw

SEQ ID NO: 594743 - DNA, 503 bp, Homo sapiens
  misc_feature: HIJSMM301BI00O.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttccttttgtcttcggaactgggaccgaggtcaccgtcctaggtcagcccaaggccaaccccactgtcta

SEQ ID NO: 594744 - DNA, 520 bp, Homo sapiens
  misc_feature: HIJSMM301BZO9G.10.86.H09.1.454.light.4.raw
catagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttgggctttcggcggagggactaagttgaccgtcctacgtcagcccaaggctgccccctcggtcact

SEQ ID NO: 594745 - DNA, 487 bp, Homo sapiens; identical to SEQ ID NO: 537220
  misc_feature: HIJSMM301AS6ET.16.53.E09.1.454.light.4.raw

SEQ ID NO: 594746 - DNA, 473 bp, Homo sapiens
  misc_feature: HIJSMM301AVTIF.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacagggtcccaccaaggttcagcggaagtggatctgggacagattttaatttcaccatcagcagcctccaacgtgatgatgttgcaacatactattgtcagcatatgattttgctcctccgagtgccacttttggcggggggtaccgaaggtggtacatcaaacgaa

SEQ ID NO: 594747 - DNA, 500 bp, Homo sapiens
  misc_feature: HIJSMM301BWNW3.16.67.G01.1.454.light.4.raw
tgtactactccacgaccggtgctcgatttagagtatacatattgggtttggggggtagctcaggaagcagagcctggagcatctccactatggcctgggctccactacttctcaccctcctcgctcactgcacaggttcttgggccaattttacgctgactcagccccactctgtgtcggagtctccggggaagacggtgaccatctcctgcacccgcagcagtggcagcattgccaggaactttgtgcagtggttccagcagcgcccgggcagtgcccccaccagtgtgatctatgaagataatcaaaggccctctggggtccctgatcgcttctctggctccatcgacacctcctccaactcagcctccctcaccatctctggagtgaagcctgaggacgaggctgactactactgtcagtcttttaatgacaccgttgtgatattcggcggagggaccaagctgaccgtcctagtcagcccaaggctgccccctggt

SEQ ID NO: 594748 - DNA, 495 bp, Homo sapiens; identical to SEQ ID NO: 563808
  misc_feature: HIJSMM301BFAAZ.40.57.F02.1.454.light.4.raw

SEQ ID NO: 594749 - DNA, 504 bp, Homo sapiens; identical to SEQ ID NO: 538423
  misc_feature: HIJSMM301AM0XC.48.67.G01.1.454.light.4.raw

SEQ ID NO: 594750 - DNA, 494 bp, Homo sapiens; identical to SEQ ID NO: 537272
  misc_feature: HIJSMM301DGKZZ.47.78.H01.1.454.light.4.raw

SEQ ID NO: 594751 - DNA, 504 bp, Homo sapiens
  misc_feature: HIJSMM301CFEAQ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaaacacttatgtcttcgggactgggaccaagatcaccgtcctaggtcagcccaaggcccaacccactgtcta

SEQ ID NO: 594752 - DNA, 509 bp, Homo sapiens; identical to SEQ ID NO: 541829
  misc_feature: HIJSMM301DS6EW.17.28.C06.1.454.light.4.raw

SEQ ID NO: 594753 - DNA, 503 bp, Homo sapiens
  misc_feature: HIJSMM301A4SEM.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacgacggtcaccgtcctaggtcagccccaaggcccaacccca

SEQ ID NO: 594754 - DNA, 476 bp, Homo sapiens
  misc_feature: HIJSMM301CMUR6.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcgcggcggcc

SEQ ID NO: 594755 - DNA, 505 bp, Homo sapiens
  misc_feature: HIJSMM301BATG3.51.10.A10.1.454.light.4.raw
cgatcgtatacacgaccggtgctcgatttagcgtcgatctcaggggagctgtgggtagagaagacaggactcaggacaatctccagcatggccagcttccctctcctcctcaccctcctcactcactgtgcagggtcctgggcccaatctgtgctgactcagccaccctcagcgtctgggacccccgggcagagggtcaccatctcctgttctggaagcaactccaacatcggaagttatactgcagactggtaccagcaactcccaggatcggcccccaaactcctcatctatactactaatcaacgggccacaggggtccctgaccgattctccggctccaagtctggcacctcagcctccctggccatcagtggtctccagtctgaggatgaggctcaatacttctgtgcatcatgggatgacagtttgaatggtccggtgttcggcggagggaccaaactgaccgtccttagtcagcccaaggctgccccctcggtcactc

SEQ ID NO: 594756 - DNA, 504 bp, Homo sapiens; identical to SEQ ID NO: 544267
  misc_feature: HIJSMM301ELSG9.19.85.H08.1.454.light.4.raw

SEQ ID NO: 594757 - DNA, 504 bp, Homo sapiens
  misc_feature: HIJSMM301A4GN7.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggtgtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctcgccccctc

SEQ ID NO: 594758 - DNA, 506 bp, Homo sapiens; identical to SEQ ID NO: 535058
  misc_feature: HIJSMM301BUEVG.17.41.D08.1.454.light.4.raw

SEQ ID NO: 594759 - DNA, 476 bp, Homo sapiens; identical to SEQ ID NO: 538026
  misc_feature: HIJSMM301DHALZ.13.76.G10.1.454.light.4.raw

SEQ ID NO: 594760 - DNA, 499 bp, Homo sapiens; identical to SEQ ID NO: 547044
  misc_feature: HIJSMM301BFCVB.43.71.G05.1.454.light.4.raw

SEQ ID NO: 594761 - DNA, 494 bp, Homo sapiens
  misc_feature: HIJSMM301CJJMY.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaactttattttgtcaacaggctaacacctttccccctcactttcggcggagggaccaaaggtggagagtcaagcgaactgtggctgcaccatctgtctt

SEQ ID NO: 594762 - DNA, 515 bp, Homo sapiens; identical to SEQ ID NO: 560289
  misc_feature: HIJSMM301AYNMU.16.85.H08.1.454.light.4.raw

SEQ ID NO: 594763 - DNA, 523 bp, Homo sapiens
  misc_feature: HIJSMM301AUJ6D.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaaacaaaaactggggaaacgcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttcccggaaccccgttactttcggtcggagggaccgaacggtagggtaggagtcaaaaccgaaacgtactgggcgtgcgaccaactctcgtcttctactcttccccg

SEQ ID NO: 594764 - DNA, 507 bp, Homo sapiens
  misc_feature: HIJSMM301DC22Y.10.71.G05.1.454.light.4.raw
  modified_base (492)..(492): a, c, t, g, unknown or other
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtgtatcaacataaatccggccaggctcccaggctcctcatctttgatgctttcaacagggcccctggcgtcccaggcaggttcagtggcaggtgggtctggggacagacttcactctcaccatcagcagcctagagcctgaagattttgctagtttattactgtcagcagcgtgccactttcggcggaggtgccactttcggcggacgggacgaaactaagaggtacgaaacaacgtagtggcgngcacactctgtcttc

SEQ ID NO: 594765 - DNA, 487 bp, Homo sapiens
  misc_feature: HIJSMM301EDJXI.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcgggcggagggacccaaggcctgacccgtcctaggtcacgg

SEQ ID NO: 594766 - DNA, 491 bp, Homo sapiens
  misc_feature: HIJSMM301D3DAJ.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaa

SEQ ID NO: 594767 - DNA, 490 bp, Homo sapiens; identical to SEQ ID NO: 567926
  misc_feature: HIJSMM301CT4M1.22.57.F02.1.454.light.4.raw

SEQ ID NO: 594768 - DNA, 509 bp, Homo sapiens
  misc_feature: HIJSMM301CUXLE.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtaggaaatcaaacgaactagtggctgcaccatctgtcttcatcttcccgcc

SEQ ID NO: 594769 - DNA, 473 bp, Homo sapiens
  misc_feature: HIJSMM301D159S.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacaggaaattcactttcaccatcagcagcctgcaacctgaagatattgcaacatattactgtcaacagtatgatagtctggccgccttcggcggagggaccgaaggtggagatacgacgaa

SEQ ID NO: 594770 - DNA, 468 bp, Homo sapiens
  misc_feature: HIJSMM301AMBKB.11.70.G04.1.454.light.4.raw
  modified_base (432)..(432): a, c, t, g, unknown or other
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcagggtcccatctcgattcagtggcagtggatctgggacagatttcactctcaccatcagcagcctgcagcctgaagatgttgcaacttattactgtcaaaagaatagcgctgccccgntccagtttcggcggagggccaaaggtcggagatacg

SEQ ID NO: 594771 - DNA, 507 bp, Homo sapiens; identical to SEQ ID NO: 539817
  misc_feature: HIJSMM301A3YZ0.5.24.C02.1.454.light.4.raw

SEQ ID NO: 594772 - DNA, 487 bp, Homo sapiens; identical to SEQ ID NO: 537079
  misc_feature: HIJSMM301DEYKI.14.55.E11.1.454.light.4.raw

SEQ ID NO: 594773 - DNA, 488 bp, Homo sapiens; identical to SEQ ID NO: 536710
  misc_feature: HIJSMM301EI43A.21.55.E11.1.454.light.4.raw

SEQ ID NO: 594774 - DNA, 521 bp, Homo sapiens; identical to SEQ ID NO: 538715
  misc_feature: HIJSMM301B2NNT.27.23.C01.1.454.light.4.raw

SEQ ID NO: 594775 - DNA, 518 bp, Homo sapiens; identical to SEQ ID NO: 535407
  misc_feature: HIJSMM301AJQP3.22.30.C08.1.454.light.4.raw

SEQ ID NO: 594776 - DNA, 493 bp, Homo sapiens; identical to SEQ ID NO: 548342
  misc_feature: HIJSMM301AIBFA.27.78.H01.1.454.light.4.raw

SEQ ID NO: 594777 - DNA, 488 bp, Homo sapiens; identical to SEQ ID NO: 542699
  misc_feature: HIJSMM301CZPH2.12.51.E07.1.454.light.4.raw

SEQ ID NO: 594778 - DNA, 501 bp, Homo sapiens
  misc_feature: HIJSMM301DT1S5.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactggaccgaggtcaccgtcctaggtcagcccaaggccaacccactgtca

SEQ ID NO: 594779 - DNA, 492 bp, Homo sapiens
  misc_feature: HIJSMM301CP9L9.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggcctgccccctcggtcactctgttcctctgtcgagcgt

SEQ ID NO: 594780 - DNA, 479 bp, Homo sapiens; identical to SEQ ID NO: 537349
  misc_feature: HIJSMM301DWCU6.48.28.C06.1.454.light.4.raw

SEQ ID NO: 594781 - DNA, 490 bp, Homo sapiens; identical to SEQ ID NO: 535526
  misc_feature: HIJSMM301A9GD0.26.78.H01.1.454.light.4.raw

SEQ ID NO: 594782 - DNA, 505 bp, Homo sapiens
  misc_feature: HIJSMM301BUYJP.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccaaggtaggaaatacaaacgaactagtggctgcaccatctgtcttcatcttccccg

SEQ ID NO: 594783 - DNA, 505 bp, Homo sapiens
  misc_feature: HIJSMM301AOHME.27.78.H01.1.454.light.4.raw
agcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctacaagtgatcaccttcggccaagggacacgactggagattaaacg

SEQ ID NO: 594784 - DNA, 488 bp, Homo sapiens; identical to SEQ ID NO: 540342
  misc_feature: HIJSMM301ENEVL.43.33.C11.1.454.light.4.raw

SEQ ID NO: 594785 - DNA, 487 bp, Homo sapiens
  misc_feature: HIJSMM301AI943.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaaggaccaagctggagatcaaacgaactgtggctgcacc

SEQ ID NO: 594786 - DNA, 509 bp, Homo sapiens
  misc_feature: HIJSMM301ER5IK.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggatggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccta

SEQ ID NO: 594787 - DNA, 475 bp, Homo sapiens
  misc_feature: HIJSMM301CHBNI.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaattagttcaccttaaggaacagccaagcgctagccagttaagtgaggcatctcaattgcaaggttttctctgcatcggtcaggttagtgatattaacagcgaaaagagatttttgtaaggggaaagtaatgaagttaacactgtggatcaccttcggccaagggacacgactggagattaaacgaactgtggctgcaccatctgtcttcatcttcccgccatctgaagtatagtct

SEQ ID NO: 594788 - DNA, 478 bp, Homo sapiens; identical to SEQ ID NO: 578778
  misc_feature: HIJSMM301B8XPP.22.6.A06.1.454.light.4.raw

SEQ ID NO: 594789 - DNA, 515 bp, Homo sapiens
  misc_feature: HIJSMM301D9SQF.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtctttcggcggagggaccaagctgaccgtcctaggtcagcccaaggctgccccctcggtcactctgttcccg

SEQ ID NO: 594790 - DNA, 504 bp, Homo sapiens
  misc_feature: HIJSMM301EX20I.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaggccaacccccactg

SEQ ID NO: 594791 - DNA, 492 bp, Homo sapiens; identical to SEQ ID NO: 537395
  misc_feature: HIJSMM301BD330.16.73.G07.1.454.light.4.raw

SEQ ID NO: 594792 - DNA, 488 bp, Homo sapiens; identical to SEQ ID NO: 540827
  misc_feature: HIJSMM301C2JG1.15.49.E05.1.454.light.4.raw

SEQ ID NO: 594793 - DNA, 496 bp, Homo sapiens
  misc_feature: HIJSMM301DOO0O.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaatcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtctaagtcagcccaa

SEQ ID NO: 594794 - DNA, 518 bp, Homo sapiens; identical to SEQ ID NO: 579925
  misc_feature: HIJSMM301ERY9S.14.78.H01.1.454.light.4.raw

SEQ ID NO: 594795 - DNA, 498 bp, Homo sapiens; identical to SEQ ID NO: 540742
  misc_feature: HIJSMM301CMARR.18.59.F04.1.454.light.4.raw

SEQ ID NO: 594796 - DNA, 494 bp, Homo sapiens
  misc_feature: HIJSMM301EY4F6.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcaccgtcctgggtcagcccaaggccaacccactgtcactctcg

SEQ ID NO: 594797 - DNA, 503 bp, Homo sapiens; identical to SEQ ID NO: 538583
  misc_feature: HIJSMM301BL3D1.15.59.F04.1.454.light.4.raw

SEQ ID NO: 594798 - DNA, 506 bp, Homo sapiens
  misc_feature: HIJSMM301CN8T3.15.86.H09.1.454.light.4.raw
  modified_base (400)..(400): a, c, t, g, unknown or other
tctacgtagccacgaccggtgctcgatttagtgctatagacttgggtttgggggaacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccanacaattgatggccaaggacggttgggtgttcggcggagggaccaagctgaccgtcctaggtcagcccaaggctcgccccctggtcactctgttcccgccctcctcg

SEQ ID NO: 594799 - DNA, 499 bp, Homo sapiens
  misc_feature: HIJSMM301AM2IS.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctccgg

SEQ ID NO: 594800 - DNA, 488 bp, Homo sapiens
  misc_feature: HIJSMM301B2XW5.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcgggtttattactgcatgcagggtacagtgtggccttcgctcgcattcggcggagggaccaaggtggagagtcaaacgaa

SEQ ID NO: 594801 - DNA, 494 bp, Homo sapiens; identical to SEQ ID NO: 540110
  misc_feature: HIJSMM301CN302.51.71.G05.1.454.light.4.raw

SEQ ID NO: 594802 - DNA, 490 bp, Homo sapiens
  misc_feature: HIJSMM301BFZAL.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcatggggcagtggatctgggacagatttcactctcagcattaataatctgcaacctgaggattttgcaacttactactgtcaacagagttacaggcccccctactacttttggccaggggaccaagctggagatcacaggaactgtggctgcaccat

SEQ ID NO: 594803 - DNA, 496 bp, Homo sapiens
  misc_feature: HIJSMM301DSW3C.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaaacttcctacacttttggccaggggaccaagctggagatcaaacgaactgtggctgca

SEQ ID NO: 594804 - DNA, 487 bp, Homo sapiens
  misc_feature: HIJSMM301DOWSQ.14.56.F01.1.454.light.4.raw
cgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgt

SEQ ID NO: 594805 - DNA, 494 bp, Homo sapiens
  misc_feature: HIJSMM301CY3A5.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcaagaaaccagggaaagcccctaaactcctgatgtataaggcatctagcttagaagtggggtgccatcaaggttcagcggcagtggatctgggacagaattcactctcaccatcagcaccctgcagcctgatgattttgctaacttattactgtcaacagtataatagtaattcctggacgttcggccgaacgggaccgaaggtaggaaatacaaacgaactgtggctgcaccatctgtctt

SEQ ID NO: 594806 - DNA, 513 bp, Homo sapiens
  misc_feature: HIJSMM301CWS9L.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcctcacta

SEQ ID NO: 594807 - DNA, 522 bp, Homo sapiens
  misc_feature: HIJSMM301EMRI1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtgacacttgggtgttcggcggagggaccaggctgaccgtcctaggtcagcccaaggctgccccctcggtcactctgttcccaccct

SEQ ID NO: 594808 - DNA, 496 bp, Homo sapiens
  misc_feature: HIJSMM301AL2TG.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgacctcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagacgtggaggctgaggatgttggggtttattactgcatgcaagctctacaacctctgcggactttcggtccctcggtaccgaaa

SEQ ID NO: 594809 - DNA, 486 bp, Homo sapiens; identical to SEQ ID NO: 535043
  misc_feature: HIJSMM301D84UA.46.35.D02.1.454.light.4.raw

SEQ ID NO: 594810 - DNA, 508 bp, Homo sapiens
  misc_feature: HIJSMM301BGMPZ.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccggggaccgaccgtaggaatacaaacgaactgtggctgcaccatctgtctt

SEQ ID NO: 594811 - DNA, 497 bp, Homo sapiens; identical to SEQ ID NO: 535664
  misc_feature: HIJSMM301EJGF5.22.14.B03.1.454.light.4.raw

SEQ ID NO: 594812 - DNA, 501 bp, Homo sapiens
  misc_feature: HIJSMM301CDW6P.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactagtggctgcaccatctgtcttcatcttcccgccat

SEQ ID NO: 594813 - DNA, 484 bp, Homo sapiens; identical to SEQ ID NO: 535240
  misc_feature: HIJSMM301ELL0J.47.60.F05.1.454.light.4.raw

SEQ ID NO: 594814 - DNA, 505 bp, Homo sapiens
  misc_feature: HIJSMM301BN6TP.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctcctgaccatctcggggctccaggctgaggacgaggctgcttattactgcagctcatatacaaggagcaccactctcgtggtattggtggagggaccaagctgaccgtcctaggtcagcccaaggctcgccccctggt

SEQ ID NO: 594815 - DNA, 473 bp, Homo sapiens
  misc_feature: HIJSMM301BKKFC.3.1.A01.1.454.light.4.raw
agacgcactccacgaccggtgctcgatttagacgtctcatcaggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcaccat

SEQ ID NO: 594816 - DNA, 495 bp, Homo sapiens
  misc_feature: HIJSMM301ECVEH.49.66.F11.1.454.light.4.raw
  modified_base (391)..(391): a, c, t, g, unknown or other
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcngtttaattactgtcaacagcgtaccacaggattcacttttcggccctgggaccagagtggatatcaaacgaactgtggctgcaccatctgtcttcatcttcccg

SEQ ID NO: 594817 - DNA, 512 bp, Homo sapiens
  misc_feature: HIJSMM301C3UEH.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgttcccaccctcctcgctacg

SEQ ID NO: 594818 - DNA, 488 bp, Homo sapiens
  misc_feature: HIJSMM301ERJC1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggatatcagaacgaa

SEQ ID NO: 594819 - DNA, 483 bp, Homo sapiens
  misc_feature: HIJSMM301CJX1Q.41.15.B04.1.454.light.4.raw
tctatactatcacgaccggtgctcgatttagacagtatatatccgcgggggagtcagtctcagtcaggacacagcatggacatgagggtccccgctcagctcctggggctcctgctactctggctccgaggtgccagatgtgacatccagatgacccagtctccatcctccctgtctgcatctataggagacagagtcaccatcacttgccgggcaaatcagaacattattagatatttaaattggtatcatcacaaaccagggaaagcccctaagctcctgatctatgctgcatccaatttgcaaagtggggtcccgtcaaggttcagtggcagtggatctgggacagatttcactctcaccatcagcagtctgcaacctgaagattttgcaacttactaactgtcaacagacttacagtgcccctcggaccaccttcggccaaggacacgactggacattaacgaactgtggctgcaccta

SEQ ID NO: 594820 - DNA, 521 bp, Homo sapiens; identical to SEQ ID NO: 539470
  misc_feature: HIJSMM301EYC89.27.23.C01.1.454.light.4.raw

SEQ ID NO: 594821 - DNA, 493 bp, Homo sapiens
  misc_feature: HIJSMM301ELJ0F.49.73.G07.1.454.light.4.raw
agtcgagagacacgaccggtgctcgatttagctctacgctcagggcacgaccggtgctcgatttagacacatacgcaggggaaaggggggggtctcaggaggcagcactctcgggacgtctccaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggtagggacg

SEQ ID NO: 594822 - DNA, 485 bp, Homo sapiens
  misc_feature: HIJSMM301CIRQI.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggcctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagcccg

SEQ ID NO: 594823 - DNA, 522 bp, Homo sapiens
  misc_feature: HIJSMM301BEZVO.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccatggccaaccccactgtcactctgttcccaccctccctccgtcg

SEQ ID NO: 594824 - DNA, 480 bp, Homo sapiens
  misc_feature: HIJSMM301DKF35.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcgggcggagggaccaagctgaccgtcctaagtcagcccaac

SEQ ID NO: 594825 - DNA, 511 bp, Homo sapiens
  misc_feature: HIJSMM301CGAA9.48.28.C06.1.454.light.4.raw
agtatacatacacgaccggtgctcgatttagagctcacgtattgggtttgggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgtattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccctcct

SEQ ID NO: 594826 - DNA, 505 bp, Homo sapiens
  misc_feature: HIJSMM301DAI4P.48.69.G03.1.454.light.4.raw
agtatacatacacgaccggtgctcgatttagtcgctgcgtaaaggagaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactagtggctgcaccatctgtcttcatcttccccg

SEQ ID NO: 594827 - DNA, 490 bp, Homo sapiens
  misc_feature: HIJSMM301DCCTL.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggccttccgctcactttcggcggagggaccaaggttgagatcaaacgaactgtggctgcaccta

SEQ ID NO: 594828 - DNA, 494 bp, Homo sapiens; identical to SEQ ID NO: 535276
  misc_feature: HIJSMM301CUKEN.16.6.A06.1.454.light.4.raw

SEQ ID NO: 594829 - DNA, 480 bp, Homo sapiens; identical to SEQ ID NO: 535630
  misc_feature: HIJSMM301BZ868.40.59.F04.1.454.light.4.raw

SEQ ID NO: 594830 - DNA, 485 bp, Homo sapiens
  misc_feature: HIJSMM301EC5GY.52.38.D05.1.454.light.4.raw
cgcagtacgacacgaccggtgctcgatttagtatctgatagttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttggggtgttcggcggagggaccaagttgaccgtctaggtcagcccaaggctcg

SEQ ID NO: 594831 - DNA, 497 bp, Homo sapiens
  misc_feature: HIJSMM301DJ1AY.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatacaagacgaacgtagtggctgcaccactctgt

SEQ ID NO: 594832 - DNA, 501 bp, Homo sapiens
  misc_feature: HIJSMM301C5NPU.5.45.E01.1.454.light.4.raw
atcagacacgcacgaccggtgctcgatttagtgagtcagtaagggaaagggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcagtctgcaagctgaagattttgcaacttattactgtcaacaaagttatagtaccccgacgttcggtccaagggaccgaaggtagggagagtcaaaacgaactagttggctgcgacccatcttgtcttcta

SEQ ID NO: 594833 - DNA, 502 bp, Homo sapiens
  misc_feature: HIJSMM301EBV8Y.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggcg

SEQ ID NO: 594834 - DNA, 521 bp, Homo sapiens; identical to SEQ ID NO: 539470
  misc_feature: HIJSMM301DH2UT.27.23.C01.1.454.light.4.raw

SEQ ID NO: 594835 - DNA, 508 bp, Homo sapiens
  misc_feature: HIJSMM301EOK6O.4.57.F02.1.454.light.4.raw
agcactgtagcacgaccggtgctcgatttagctcgatatagttgggtttggggctgggcctaaggaagtagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactctcg

SEQ ID NO: 594836 - DNA, 444 bp, Homo sapiens; identical to SEQ ID NO: 535192
  misc_feature: HIJSMM301ETBEA.5.9.A09.1.454.light.4.raw

SEQ ID NO: 594837 - DNA, 480 bp, Homo sapiens; identical to SEQ ID NO: 535291
  misc_feature: HIJSMM301B37HA.22.59.F04.1.454.light.4.raw

SEQ ID NO: 594838 - DNA, 510 bp, Homo sapiens
  misc_feature: HIJSMM301CRNAD.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccagggacccgggtggaaataaaacgaactagtggctgcaccatctgtcttcatt

SEQ ID NO: 594839 - DNA, 501 bp, Homo sapiens
  misc_feature: HIJSMM301EFIIZ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacaagcaccagcactctctatgtcttcggaactgggaccaaggtcaccgtccaggtcagccaaggccaaccca

SEQ ID NO: 594840 - DNA, 354 bp, Homo sapiens; identical to SEQ ID NO: 535026
  misc_feature: HIJSMM301CIR0N.19.22.B11.1.454.light.4.raw

SEQ ID NO: 594841 - DNA, 458 bp, Homo sapiens
  misc_feature: HIJSMM301DKNTY.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcacttttcggcggagggaccaaggtggaga

SEQ ID NO: 594842 - DNA, 494 bp, Homo sapiens
  misc_feature: HIJSMM301AKVRG.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaacgaactgtggctgcaccatctgtt

SEQ ID NO: 594843 - DNA, 496 bp, Homo sapiens
  misc_feature: HIJSMM301A5ZS7.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataattccctccgtggacgttcggccaagggaccaaggagcaaatcaaacgaactgtggctgcaccatctgtcttcatcttcccgccat

SEQ ID NO: 594844 - DNA, 486 bp, Homo sapiens
  misc_feature: HIJSMM301EGYOU.49.27.C05.1.454.light.4.raw
agtcgagagacacgaccggtgctcgatttagacgcgatcgaagggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgaac

SEQ ID NO: 594845 - DNA, 505 bp, Homo sapiens; identical to SEQ ID NO: 536117
  misc_feature: HIJSMM301CGYTC.8.71.G05.1.454.light.4.raw

SEQ ID NO: 594846 - DNA, 441 bp, Homo sapiens; identical to SEQ ID NO: 535074
  misc_feature: HIJSMM301DVL33.11.3.A03.1.454.light.4.raw

SEQ ID NO: 594847 - DNA, 507 bp, Homo sapiens
  misc_feature: HIJSMM301CYIRV.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggcctgccccctcggtccta

SEQ ID NO: 594848 - DNA, 484 bp, Homo sapiens; identical to SEQ ID NO: 538247
  misc_feature: HIJSMM301EOTY1.14.53.E09.1.454.light.4.raw

SEQ ID NO: 594849 - DNA, 484 bp, Homo sapiens
  misc_feature: HIJSMM301EY41Z.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggcctgggactaaggtggagatcagacgaactgtggctgcaccatctgtcttcta

SEQ ID NO: 594850 - DNA, 500 bp, Homo sapiens
  misc_feature: HIJSMM301D0NXB.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgacctcctgcgtcagcccaaggctgccccctcggtcact

SEQ ID NO: 594851 - DNA, 501 bp, Homo sapiens
  misc_feature: HIJSMM301CX7K4.3.35.D02.1.454.light.4.raw
agacgcactccacgaccggtgctcgatttagcacacgatagttgggtttggggactgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtccgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttcttgcatgcaagctacacactggccggtacacttttggccaggggaccaagctggagatcaaacgaactgtggctgca

SEQ ID NO: 594852 - DNA, 488 bp, Homo sapiens; identical to SEQ ID NO: 535990
  misc_feature: HIJSMM301CNP5U.11.28.C06.1.454.light.4.raw

SEQ ID NO: 594853 - DNA, 513 bp, Homo sapiens
  misc_feature: HIJSMM301CIXWN.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagccaaggctgccccctcggtcactctgttccccg

SEQ ID NO: 594854 - DNA, 493 bp, Homo sapiens; identical to SEQ ID NO: 540880
  misc_feature: HIJSMM301C6FJX.40.81.H04.1.454.light.4.raw

SEQ ID NO: 594855 - DNA, 495 bp, Homo sapiens
  misc_feature: HIJSMM301CN6YL.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcat

SEQ ID NO: 594856 - DNA, 492 bp, Homo sapiens
  misc_feature: HIJSMM301AX5L5.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcagtattatagtactcctccgacgttcgccaagggaccaaggtggagattaaacgaactagtggctgcaccatctgtcttcatcttcccgccat

SEQ ID NO: 594857 - DNA, 484 bp, Homo sapiens; identical to SEQ ID NO: 594604
  misc_feature: HIJSMM301BCGWB.40.84.H07.1.454.light.4.raw

SEQ ID NO: 594858 - DNA, 506 bp, Homo sapiens
  misc_feature: HIJSMM301DGGUJ.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcact

SEQ ID NO: 594859 - DNA, 519 bp, Homo sapiens
  misc_feature: HIJSMM301EHN61.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccgccct

SEQ ID NO: 594860 - DNA, 486 bp, Homo sapiens; identical to SEQ ID NO: 535385
  misc_feature: HIJSMM301EDMXN.19.71.G05.1.454.light.4.raw

SEQ ID NO: 594861 - DNA, 506 bp, Homo sapiens
  misc_feature: HIJSMM301DHLRE.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtggccgtccgggggccacttcggccctgggaccaaagtggatatcaaacgaactgtggctgcaccatctgtctt

SEQ ID NO: 594862 - DNA, 507 bp, Homo sapiens
  misc_feature: HIJSMM301AR745.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggccccaggcagatgatgagtgtgattattactgtgtgctctatatgggcagtggcgttgggtgttcggcggagggaccaagctgaccgttcg

SEQ ID NO: 594863 - DNA, 504 bp, Homo sapiens; identical to SEQ ID NO: 585146
  misc_feature: HIJSMM301A3I6Y.5.86.H09.1.454.light.4.raw

SEQ ID NO: 594864 - DNA, 486 bp, Homo sapiens; identical to SEQ ID NO: 535458
  misc_feature: HIJSMM301CFY6L.7.75.G09.1.454.light.4.raw

SEQ ID NO: 594865 - DNA, 510 bp, Homo sapiens; identical to SEQ ID NO: 581763
  misc_feature: HIJSMM301D5JBC.43.67.G01.1.454.light.4.raw

SEQ ID NO: 594866 - DNA, 511 bp, Homo sapiens
  misc_feature: HIJSMM301CXQO8.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggaggaccaagctgaccgtcctaggtcagcccaaggctgccccctcggtcactctgtt

SEQ ID NO: 594867 - DNA, 486 bp, Homo sapiens; identical to SEQ ID NO: 537428
  misc_feature: HIJSMM301B0AW0.47.62.F07.1.454.light.4.raw

SEQ ID NO: 594868 - DNA, 512 bp, Homo sapiens
  misc_feature: HIJSMM301AN9T7.3.61.F06.1.454.light.4.raw
agacgcactccacgaccggtgctcgatttagctacgctctaagggaaaggggtgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacagccactctgactctcaccggggcccaggccatcgatgagggagactattactgtcaggcgtgggacagcacgactgcagtcttcggcggagggaccaagctgaccgtcctgggtcagcccaaggctgccccctggtcactctgttcccaccctcctcggt

SEQ ID NO: 594869 - DNA, 487 bp, Homo sapiens
  misc_feature: HIJSMM301A61K7.49.60.F05.1.454.light.4.raw
agtcgagagacacgaccggtgctcgatttagtacgtcatcagggaaaggggtgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacgaacg

SEQ ID NO: 594870 - DNA, 484 bp, Homo sapiens; identical to SEQ ID NO: 535441
  misc_feature: HIJSMM301C54EM.26.60.F05.1.454.light.4.raw

SEQ ID NO: 594871 - DNA, 476 bp, Homo sapiens
  misc_feature: HIJSMM301ASF4E.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactagtggctgca

SEQ ID NO: 594872 - DNA, 507 bp, Homo sapiens
  misc_feature: HIJSMM301COPUF.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgcct

SEQ ID NO: 594873 - DNA, 509 bp, Homo sapiens
  misc_feature: HIJSMM301C7A6D.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgccctctcgctacgt

SEQ ID NO: 594874 - DNA, 512 bp, Homo sapiens
  misc_feature: HIJSMM301C1HZ7.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggacttgggaccaaggtcaccgtcctaggtcagcccaaggccaacccactgtcactctcg

SEQ ID NO: 594875 - DNA, 517 bp, Homo sapiens
  misc_feature: HIJSMM301ARJJ2.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgttccccg

SEQ ID NO: 594876 - DNA, 505 bp, Homo sapiens; identical to SEQ ID NO: 543569
  misc_feature: HIJSMM301AOKWN.10.12.B01.1.454.light.4.raw

SEQ ID NO: 594877 - DNA, 476 bp, Homo sapiens; identical to SEQ ID NO: 538026
  misc_feature: HIJSMM301BBROS.13.76.G10.1.454.light.4.raw

SEQ ID NO: 594878 - DNA, 480 bp, Homo sapiens
  misc_feature: HIJSMM301DNJ55.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgtaggagagtgaggaggagaggagaccaggccatgctggagattgtcctgagtgctgcctcttgtgcccacagctgaagcagagcctccaaactcctcatctatggtaacagcaatcggccctcagggtccctgaccgattctctggctccaagtctggcacctcagcctccctggtcatcgctgggctccaggctgacgatgaggctgattattattgccagtcctatgacaacacctgcgtggttttggctgttcggcggcgggacc

SEQ ID NO: 594879 - DNA, 485 bp, Homo sapiens; identical to SEQ ID NO: 543370
  misc_feature: HIJSMM301B0LUZ.3.10.A10.1.454.light.4.raw

SEQ ID NO: 594880 - DNA, 470 bp, Homo sapiens
  misc_feature: HIJSMM301C0S7J.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctccgctcactttcggcgggggaccaagggtggagatacgaagcgaa

SEQ ID NO: 594881 - DNA, 508 bp, Homo sapiens; identical to SEQ ID NO: 574056
  misc_feature: HIJSMM301CTU8M.10.88.H11.1.454.light.4.raw

SEQ ID NO: 594882 - DNA, 484 bp, Homo sapiens; identical to SEQ ID NO: 535400
  misc_feature: HIJSMM301ETX82.46.26.C04.1.454.light.4.raw

SEQ ID NO: 594883 - DNA, 501 bp, Homo sapiens
  misc_feature: HIJSMM301A1LQG.40.53.E09.1.454.light.4.raw
tctagcgactcacgaccggtgctcgatttagagagagtgtgttgggtttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcggggggaccaagctgaccgtcctaagtcagcccaac

SEQ ID NO: 594884 - DNA, 477 bp, Homo sapiens
  misc_feature: HIJSMM301CAZKE.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcagggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgagtagtaca

SEQ ID NO: 594885 - DNA, 492 bp, Homo sapiens
  misc_feature: HIJSMM301EEKGT.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagatttgcaacttattactgtcaacagtttaataactaccctctcactttcggaggaggaccgagggtggagatcaaacgaactgtggctgcaccatctgtcttcta

SEQ ID NO: 594886 - DNA, 509 bp, Homo sapiens
  misc_feature: HIJSMM301A1DDB.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcaggtgggtctgggactttcgttcactctcaccatcaataacctgcaatctgacgactttgcagtttatttctgtcagcagtctgaagactggccgttcacgtttcggcggagggaccaaggtggacctcaaacgaactgtggctgcaccatctgtcttcactcttcccgcc

SEQ ID NO: 594887 - DNA, 494 bp, Homo sapiens; identical to SEQ ID NO: 534992
  misc_feature: HIJSMM301CYDLG.9.1.A01.1.454.light.4.raw

SEQ ID NO: 594888 - DNA, 484 bp, Homo sapiens; identical to SEQ ID NO: 547458
  misc_feature: HIJSMM301EIEZM.15.1.A01.1.454.light.4.raw

SEQ ID NO: 594889 - DNA, 495 bp, Homo sapiens
  misc_feature: HIJSMM301DP76J.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtgagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaaccttcggccaagggacacgactggagattaaaggaactgtggctgcaccatctgtcttcatcttccccg

SEQ ID NO: 594890 - DNA, 480 bp, Homo sapiens
  misc_feature: HIJSMM301D58LT.52.1.A01.1.454.light.4.raw
cgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggcccttgggaccatagtggatatcaaacgaactgtggctgcaccatctgtt

SEQ ID NO: 594891 - DNA, 478 bp, Homo sapiens
  misc_feature: HIJSMM301D90NO.40.23.C01.1.454.light.4.raw
tctagcgactcacgaccggtgctcgatttagtacacgtgattagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaa

SEQ ID NO: 594892 - DNA, 505 bp, Homo sapiens; identical to SEQ ID NO: 578959
  misc_feature: HIJSMM301BE23G.16.46.E02.1.454.light.4.raw

SEQ ID NO: 594893 - DNA, 501 bp, Homo sapiens; identical to SEQ ID NO: 540528
  misc_feature: HIJSMM301ELTH0.11.31.C09.1.454.light.4.raw

SEQ ID NO: 594894 - DNA, 454 bp, Homo sapiens; identical to SEQ ID NO: 534964
  misc_feature: HIJSMM301DLR62.19.86.H09.1.454.light.4.raw

SEQ ID NO: 594895 - DNA, 495 bp, Homo sapiens
  misc_feature: HIJSMM301CQWFS.27.78.H01.1.454.light.4.raw
  modified_base (404)..(404): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattacngtcatcagagtactactttacctcaagtgatcaccttcggccaagggacacgactggagattaaacgaactgtggctgcaccatctgtctt

SEQ ID NO: 594896 - DNA, 502 bp, Homo sapiens; identical to SEQ ID NO: 543172
  misc_feature: HIJSMM301DF82H.18.59.F04.1.454.light.4.raw

SEQ ID NO: 594897 - DNA, 486 bp, Homo sapiens; identical to SEQ ID NO: 535917
  misc_feature: HIJSMM301DM4T3.3.10.A10.1.454.light.4.raw

SEQ ID NO: 594898 - DNA, 513 bp, Homo sapiens; identical to SEQ ID NO: 568633
  misc_feature: HIJSMM301E0A7Y.8.71.G05.1.454.light.4.raw

SEQ ID NO: 594899 - DNA, 475 bp, Homo sapiens; identical to SEQ ID NO: 543110
  misc_feature: HIJSMM301B3F5V.3.1.A01.1.454.light.4.raw

SEQ ID NO: 594900 - DNA, 494 bp, Homo sapiens; identical to SEQ ID NO: 534994
  misc_feature: HIJSMM301DQE4P.27.78.H01.1.454.light.4.raw

SEQ ID NO: 594901 - DNA, 503 bp, Homo sapiens; identical to SEQ ID NO: 538884
  misc_feature: HIJSMM301APCP8.27.78.H01.1.454.light.4.raw

SEQ ID NO: 594902 - DNA, 511 bp, Homo sapiens
  misc_feature: HIJSMM301AFXVE.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaaagagatttttgttaagggaaagtaatgaagttaa

SEQ ID NO: 594903 - DNA, 499 bp, Homo sapiens; identical to SEQ ID NO: 578427
  misc_feature: HIJSMM301DTOFR.47.66.F11.1.454.light.4.raw

SEQ ID NO: 594904 - DNA, 501 bp, Homo sapiens
  misc_feature: HIJSMM301AVPHK.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcaggggtcttcggcggagggacgaagctgaccgtcctgagtcagcccaaggctgccccctcggtcactctgttccccg

SEQ ID NO: 594905 - DNA, 489 bp, Homo sapiens; identical to SEQ ID NO: 535139
  misc_feature: HIJSMM301E10IM.14.55.E11.1.454.light.4.raw

SEQ ID NO: 594906 - DNA, 499 bp, Homo sapiens; identical to SEQ ID NO: 538774
  misc_feature: HIJSMM301AY287.26.26.C04.1.454.light.4.raw

SEQ ID NO: 594907 - DNA, 514 bp, Homo sapiens; identical to SEQ ID NO: 544770
  misc_feature: HIJSMM301BTUMI.16.66.F11.1.454.light.4.raw

SEQ ID NO: 594908 - DNA, 494 bp, Homo sapiens; identical to SEQ ID NO: 534992
  misc_feature: HIJSMM301EILBW.9.1.A01.1.454.light.4.raw

SEQ ID NO: 594909 - DNA, 466 bp, Homo sapiens; identical to SEQ ID NO: 535366
  misc_feature: HIJSMM301AYUZ9.13.4.A04.1.454.light.4.raw

SEQ ID NO: 594910 - DNA, 508 bp, Homo sapiens
  misc_feature: HIJSMM301C34KG.2.35.D02.1.454.light.4.raw
  modified_base (466)..(466): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcgtcggagggaccgaagcngaccgtccctgggtcgagcccaacggctgcccctccggtcaa

SEQ ID NO: 594911 - DNA, 483 bp, Homo sapiens; identical to SEQ ID NO: 545057
  misc_feature: HIJSMM301C6U5B.48.37.D04.1.454.light.4.raw

SEQ ID NO: 594912 - DNA, 478 bp, Homo sapiens; identical to SEQ ID NO: 535129
  misc_feature: HIJSMM301CG9EQ.11.11.A11.1.454.light.4.raw

SEQ ID NO: 594913 - DNA, 503 bp, Homo sapiens
  misc_feature: HIJSMM301BA0KZ.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctcctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 594914 - DNA, 508 bp, Homo sapiens
  misc_feature: HIJSMM301B87FE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaagggaccgaaggtggaaatacaaacgaactagtggctggcaccactctgtcttctatcttccccg

SEQ ID NO: 594915 - DNA, 457 bp, Homo sapiens
  misc_feature: HIJSMM301CS9VM.49.8.A08.1.454.light.4.raw
agtcgagagacacgaccggtgctcgatttagcatactctacagggggtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacagggtcccatcaaggttcagtggaagtggctctgggacagattttactttcaccatcagcaggctgcagcctgaagatattgcaacatattactgtcaacagtatgatcgcctcccgctcactttcggcgggggccaaggtggagatcaagcgaa

SEQ ID NO: 594916 - DNA, 505 bp, Homo sapiens
  misc_feature: HIJSMM301EVL3U.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatggaaggagactactattgttactctccagagaaggatggtcatcattgggtgttcggcggagggaccaagctgaccgtcctaagtcagcccaaggctgccccctcggtcactctgttcccgcct

SEQ ID NO: 594917 - DNA, 494 bp, Homo sapiens
  misc_feature: HIJSMM301CWJ73.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccgggcagtctcctaagttgctcatttactgggcgtctacccgggaatccggggtccctgaccgattcagtggcagcgggtctgggacagatttcactctcaccatcagcagcctgcaggttgaagatgtggctagtttattactgtcagcagtattatactactcctctgacgttcggccaagggaccaaggtggagatcaaacgaactgtggctgcaccat

SEQ ID NO: 594918 - DNA, 503 bp, Homo sapiens; identical to SEQ ID NO: 547049
  misc_feature: HIJSMM301BS30H.18.59.F04.1.454.light.4.raw

SEQ ID NO: 594919 - DNA, 522 bp, Homo sapiens
  misc_feature: HIJSMM301BC4DK.12.71.G05.1.454.light.4.raw
atacgacgtacacgaccggtgctcgatttagtgtcgtcgcaagagagagggggggggtcgacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccgaaagtgaccgtcctaagtcagccaaggctgccccctcggtcactctcgtcccaccct

SEQ ID NO: 594920 - DNA, 486 bp, Homo sapiens; identical to SEQ ID NO: 535385
  misc_feature: HIJSMM301DP8JZ.19.71.G05.1.454.light.4.raw

SEQ ID NO: 594921 - DNA, 503 bp, Homo sapiens
  misc_feature: HIJSMM301CFAS1.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccactgtca

SEQ ID NO: 594922 - DNA, 484 bp, Homo sapiens
  misc_feature: HIJSMM301ECX3K.4.71.G05.1.454.light.4.raw
agcactgtagcacgaccggtgctcgatttagtgtcgtcgcaagagagagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactccttcactttcggcggagggaccaaggtggagatcaaacgaa

SEQ ID NO: 594923 - DNA, 490 bp, Homo sapiens; identical to SEQ ID NO: 535234
  misc_feature: HIJSMM301C8FR7.17.21.B10.1.454.light.4.raw

SEQ ID NO: 594924 - DNA, 496 bp, Homo sapiens
  misc_feature: HIJSMM301EPLH4.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactccgggccagcagtggtaacattgtgatattcggcggagggaccaaggtgaccgtcctacgtcagcccaaggctcgccccctggccactctcg

SEQ ID NO: 594925 - DNA, 457 bp, Homo sapiens; identical to SEQ ID NO: 536586
  misc_feature: HIJSMM301CEK0O.49.85.H08.1.454.light.4.raw

SEQ ID NO: 594926 - DNA, 496 bp, Homo sapiens; identical to SEQ ID NO: 557182
  misc_feature: HIJSMM301EJYAR.9.1.A01.1.454.light.4.raw

SEQ ID NO: 594927 - DNA, 520 bp, Homo sapiens
  misc_feature: HIJSMM301BW47H.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgcccccgtcggtcactctcgttcccaccctcctccacg

SEQ ID NO: 594928 - DNA, 510 bp, Homo sapiens
  misc_feature: HIJSMM301CK57R.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggactggaccaaggtcaccgtcctacgtcacgccaacggccaacccactgtcactctcgttcccaccct

SEQ ID NO: 594929 - DNA, 500 bp, Homo sapiens
  misc_feature: HIJSMM301ANOEG.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttcaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcact

SEQ ID NO: 594930 - DNA, 502 bp, Homo sapiens
  misc_feature: HIJSMM301EX6YI.4.39.D06.1.454.light.4.raw
agcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcgggcggagggaccaaactgaccgtcctaggtcagcccaaggctgccccctc

SEQ ID NO: 594931 - DNA, 498 bp, Homo sapiens; identical to SEQ ID NO: 535295
  misc_feature: HIJSMM301C5XDP.15.25.C03.1.454.light.4.raw

SEQ ID NO: 594932 - DNA, 504 bp, Homo sapiens
  misc_feature: HIJSMM301CFDME.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcacccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagtttacactttatgttcttcggaattgggacgacggtcaccgtcctaggtcagcccaaggccaacccca

SEQ ID NO: 594933 - DNA, 513 bp, Homo sapiens; identical to SEQ ID NO: 559106
  misc_feature: HIJSMM301DJZD1.11.57.F02.1.454.light.4.raw

SEQ ID NO: 594934 - DNA, 503 bp, Homo sapiens
  misc_feature: HIJSMM301EYGJ5.53.49.E05.1.454.light.4.raw
  modified_base (108)..(108): a, c, t, g, unknown or other
cgcgtatacacacgaccggtgctcgatttagagcgactagcaacacacaaaggggctgggcctaaggaagcagcactggtggtgcctcagccatggcctggaccgttntcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcggtcact

SEQ ID NO: 594935 - DNA, 502 bp, Homo sapiens; identical to SEQ ID NO: 536604
  misc_feature: HIJSMM301CEB3V.27.78.H01.1.454.light.4.raw

SEQ ID NO: 594936 - DNA, 547 bp, Homo sapiens
  misc_feature: HIJSMM301EOJ65.17.33.C11.1.454.light.4.raw
  modified_base (519)..(519): a, c, t, g, unknown or other
cgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcggggctttcgacccgcgtttatcgttacttatgtcagcattcgcacttctgatacctccagcatgcctcacagcacacccttcacaggcttacagaacgctcccctacccaacaacgcataagcgtcgctgccgcagcttcggtgccatggtttncccccgtttcatcttcccgcatctgact

SEQ ID NO: 594937 - DNA, 515 bp, Homo sapiens
  misc_feature: HIJSMM301CMPNU.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcacccttttatgtcttcgggactgtgaccaaggtcaccgtcctaggtcagcccaaggccaaccccactgtcactctgttcccca

SEQ ID NO: 594938 - DNA, 496 bp, Homo sapiens
  misc_feature: HIJSMM301C5TLH.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaaggtggagatcaagcgaactgtggctgcaccactctcgtcttctatcttcccgt

SEQ ID NO: 594939 - DNA, 498 bp, Homo sapiens; identical to SEQ ID NO: 535295
  misc_feature: HIJSMM301DZ4IV.15.25.C03.1.454.light.4.raw

SEQ ID NO: 594940 - DNA, 494 bp, Homo sapiens; identical to SEQ ID NO: 534992
  misc_feature: HIJSMM301ASEQM.9.1.A01.1.454.light.4.raw

SEQ ID NO: 594941 - DNA, 496 bp, Homo sapiens
  misc_feature: HIJSMM301DLBN4.26.23.C01.1.454.light.4.raw
  modified_base (427)..(427): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattntccagcgttcggtccaggggaccgaacggtaggaaggtacaagacgaactagtggtctgcaccatctgt

SEQ ID NO: 594942 - DNA, 496 bp, Homo sapiens; identical to SEQ ID NO: 535541
  misc_feature: HIJSMM301CE6RT.3.33.C11.1.454.light.4.raw

SEQ ID NO: 594943 - DNA, 503 bp, Homo sapiens
  misc_feature: HIJSMM301A8DIA.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatccggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctg

SEQ ID NO: 594944 - DNA, 477 bp, Homo sapiens
  misc_feature: HIJSMM301CHI3S.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggtcaggggaccaagctggagaggaaacgaactgtggctgcaccat

SEQ ID NO: 594945 - DNA, 466 bp, Homo sapiens; identical to SEQ ID NO: 536398
  misc_feature: HIJSMM301BCFR7.3.20.B09.1.454.light.4.raw

SEQ ID NO: 594946 - DNA, 494 bp, Homo sapiens; identical to SEQ ID NO: 534992
  misc_feature: HIJSMM301BKXSE.9.1.A01.1.454.light.4.raw

SEQ ID NO: 594947 - DNA, 502 bp, Homo sapiens
  misc_feature: HIJSMM301C122N.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtctaggtcagcccaaggctcgccccctc

SEQ ID NO: 594948 - DNA, 486 bp, Homo sapiens; identical to SEQ ID NO: 535043
  misc_feature: HIJSMM301C2TW8.46.35.D02.1.454.light.4.raw

SEQ ID NO: 594949 - DNA, 441 bp, Homo sapiens; identical to SEQ ID NO: 535074
  misc_feature: HIJSMM301ASXU2.11.3.A03.1.454.light.4.raw

SEQ ID NO: 594950 - DNA, 496 bp, Homo sapiens; identical to SEQ ID NO: 536828
  misc_feature: HIJSMM301D41EC.3.71.G05.1.454.light.4.raw

SEQ ID NO: 594951 - DNA, 495 bp, Homo sapiens
  misc_feature: HIJSMM301AXJUY.51.83.H06.1.454.light.4.raw
cgatcgtatacacgaccggtgctcgatttagatcacgtgcgtcgcggggtgggggcacttctccctctaacactctccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaaggtggaaatcaaacgaactagtggctgcaccatctgtcttcatcttcccgccat

SEQ ID NO: 594952 - DNA, 494 bp, Homo sapiens; identical to SEQ ID NO: 534992
  misc_feature: HIJSMM301AZ7QC.9.1.A01.1.454.light.4.raw

SEQ ID NO: 594953 - DNA, 485 bp, Homo sapiens; identical to SEQ ID NO: 536075
  misc_feature: HIJSMM301CUMSF.17.21.B10.1.454.light.4.raw

SEQ ID NO: 594954 - DNA, 520 bp, Homo sapiens
  misc_feature: HIJSMM301A0VNS.13.55.E11.1.454.light.4.raw
tcacgtactacacgaccggtgctcgatttagcactcgcacgttggggtttggggggggtcgacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccccg

SEQ ID NO: 594955 - DNA, 515 bp, Homo sapiens
  misc_feature: HIJSMM301CHRW2.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggacgaacggtaggaggtacaacgaactacgtggcgtggcaccactctgtcttctacttccttcccgtcccact

SEQ ID NO: 594956 - DNA, 493 bp, Homo sapiens; identical to SEQ ID NO: 544835
  misc_feature: HIJSMM301EL2OP.43.29.C07.1.454.light.4.raw

SEQ ID NO: 594957 - DNA, 486 bp, Homo sapiens; identical to SEQ ID NO: 535043
  misc_feature: HIJSMM301C58KH.46.35.D02.1.454.light.4.raw

SEQ ID NO: 594958 - DNA, 500 bp, Homo sapiens; identical to SEQ ID NO: 585450
  misc_feature: HIJSMM301BCR8D.52.55.E11.1.454.light.4.raw

SEQ ID NO: 594959 - DNA, 484 bp, Homo sapiens
  misc_feature: HIJSMM301ETXNB.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctgactcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggtatatcaaacgaactagtggctgcaccatctgtt

SEQ ID NO: 594960 - DNA, 485 bp, Homo sapiens; identical to SEQ ID NO: 546273
  misc_feature: HIJSMM301CB3DO.43.36.D03.1.454.light.4.raw

SEQ ID NO: 594961 - DNA, 499 bp, Homo sapiens
  misc_feature: HIJSMM301CR0UL.3.14.B03.1.454.light.4.raw
agacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcactttatttctgtcagcagtataataactggcctccgtggacgttcggtccggggaccgaaggtggagagtacaaacgaactagtggcgtgcaccactctgtctt

SEQ ID NO: 594962 - DNA, 444 bp, Homo sapiens; identical to SEQ ID NO: 539971
  misc_feature: HIJSMM301EGR0A.8.73.G07.1.454.light.4.raw
  modified_base (426)..(426): a, c, t, g, unknown or other

SEQ ID NO: 594963 - DNA, 500 bp, Homo sapiens
  misc_feature: HIJSMM301CWBCO.52.55.E11.1.454.light.4.raw
cgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 594964 - DNA, 539 bp, Homo sapiens
  misc_feature: HIJSMM301AOE0U.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccacctttcggcccgtcggaccgaaaacttagtaggatacaaacgaaaccgtacgtggtcgtcgtcgacccactacttcgtcgtttctactctttccccgtcccacct

SEQ ID NO: 594965 - DNA, 496 bp, Homo sapiens; identical to SEQ ID NO: 535423
  misc_feature: HIJSMM301DV6MK.3.33.C11.1.454.light.4.raw

SEQ ID NO: 594966 - DNA, 483 bp, Homo sapiens
  misc_feature: HIJSMM301EWBXD.10.77.G11.1.454.light.4.raw
  modified_base (460)..(460): a, c, t, g, unknown or other
  modified_base (474)..(474): a, c, t, g, unknown or other
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctggggacagacttcactctcaccatcagcagactagagcctgaagattttgcagtttattactgtcagcagcgtagcaactggcctcggacgttcgcaaggaccaagtagagancaagcgactatggntgcaccatc

SEQ ID NO: 594967 - DNA, 499 bp, Homo sapiens
  misc_feature: HIJSMM301BIU82.15.21.B10.1.454.light.4.raw
tctacgtagccacgaccggtgctcgatttagtgtcgtcgcaagagaggagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctcttcactttcggcggtagggaccaaaggtggatatcaaacgaactgtggctgcaccta

SEQ ID NO: 594968 - DNA, 525 bp, Homo sapiens
  misc_feature: HIJSMM301B67E3.43.67.G01.1.454.light.4.raw
tgtgagtagtcacgaccggtgctcgatttagagtatacatattgggtttgggcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctggggacagacttcactctcaccatcagtacgcctgcagcctagaagatgtggctaacttattactgtacaactaatttcgttatactccgccgacgttcggtccgggacccggaccgtaac

SEQ ID NO: 594969 - DNA, 503 bp, Homo sapiens
  misc_feature: HIJSMM301EDTFA.53.86.H09.1.454.light.4.raw
cgcgtatacacacgaccggtgctcgatttagtgctatagacttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactctcg

SEQ ID NO: 594970 - DNA, 488 bp, Homo sapiens; identical to SEQ ID NO: 535990
  misc_feature: HIJSMM301DA93H.11.28.C06.1.454.light.4.raw

SEQ ID NO: 594971 - DNA, 484 bp, Homo sapiens; identical to SEQ ID NO: 555091
  misc_feature: HIJSMM301EKN9M.3.55.E11.1.454.light.4.raw

SEQ ID NO: 594972 - DNA, 514 bp, Homo sapiens
  misc_feature: HIJSMM301AZ690.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgacccatctctgggctcgagtctgaggacgaggctgattacttctgttgctcttgggcactactgtcgtttgggtgttcggcggagggaccaagttgaccgtcctaggtcagcccaaggctgccccctcggtcactctgttccccg

SEQ ID NO: 594973 - DNA, 521 bp, Homo sapiens
  misc_feature: HIJSMM301AKPAI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccggctccagcctgaggacgaggctgattattattgtagttcatatacaaccagtgacacttgggtgttcgggcggagggaccaggctgaccgtcctaggtcagcccaaggctgccccctcggtcactctgttcccaccct

SEQ ID NO: 594974 - DNA, 494 bp, Homo sapiens; identical to SEQ ID NO: 534992
  misc_feature: HIJSMM301D9VRT.9.1.A01.1.454.light.4.raw

SEQ ID NO: 594975 - DNA, 497 bp, Homo sapiens
  misc_feature: HIJSMM301B11QL.52.71.G05.1.454.light.4.raw
cgcagtacgacacgaccggtgctcgatttagtgtcgtcgcaagagagaggggggaaaaggccctgaggagaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgtcttgagctctggctcagtctctcctaatttctaccccagctggtaccagcagaccccaggccaggctccacgcacgctcatctacagcacaattactcgctcttctggggtccctgatcgcttctctggctccatccttgggaacaagctgccctaaccatcacgggggcccaggcagatgatgaatctgattattactgtgtcctctatatgggtagtggcatttggatgttcggcggagggaccg

SEQ ID NO: 594976 - DNA, 510 bp, Homo sapiens
  misc_feature: HIJSMM301BDVYR.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggccgtccgggggccactttcggccctgggaccaaaattgagatcaaacgaactgtggctgcaccatctgtcttcatcttcccg

SEQ ID NO: 594977 - DNA, 533 bp, Homo sapiens
  misc_feature: HIJSMM301CAJFB.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggacgaacggtacggaaggtacgaacgaaacgtaacgtaggtcgtgtcgaccgacactcgtcttctactcttcctcccgacctctcgtact

SEQ ID NO: 594978 - DNA, 492 bp, Homo sapiens
  misc_feature: HIJSMM301ADKZM.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcggacgagtcaggatgttggcgaccgcttagtctggtatcagcagaaaccaggaaaaggccctagactcctaatctatggtgcgtcccggttgcacagtggcgtcccaggaagattcagcggcggtggatctagggcagtattttactctcaccatcaatcacctgcaggctgaggtattttgctaacttactactgtcagcaggctaacaggctcgcccccaaccttcggccaggggacacgactggagattaaacgaactgtggctgcaccatctgtctt

SEQ ID NO: 594979 - DNA, 496 bp, Homo sapiens; identical to SEQ ID NO: 535109
  misc_feature: HIJSMM301ANOWK.16.78.H01.1.454.light.4.raw

SEQ ID NO: 594980 - DNA, 495 bp, Homo sapiens
  misc_feature: HIJSMM301C9LHL.52.38.D05.1.454.light.4.raw
cgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 594981 - DNA, 504 bp, Homo sapiens; identical to SEQ ID NO: 538940
  misc_feature: HIJSMM301AYJNJ.2.35.D02.1.454.light.4.raw

SEQ ID NO: 594982 - DNA, 495 bp, Homo sapiens
  misc_feature: HIJSMM301DNW0E.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggtagggaccaaggtggagatacaaacgaact

SEQ ID NO: 594983 - DNA, 477 bp, Homo sapiens
  misc_feature: HIJSMM301AIUNP.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgataactctcccactcactttcggcggagggaccaaggtggagatcaaacgaactgtggctgcacc

SEQ ID NO: 594984 - DNA, 503 bp, Homo sapiens; identical to SEQ ID NO: 559148
  misc_feature: HIJSMM301BOXE9.7.31.C09.1.454.light.4.raw

SEQ ID NO: 594985 - DNA, 454 bp, Homo sapiens; identical to SEQ ID NO: 536347
  misc_feature: HIJSMM301CDHB8.19.86.H09.1.454.light.4.raw

SEQ ID NO: 594986 - DNA, 519 bp, Homo sapiens
  misc_feature: HIJSMM301AQM0I.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtacggaagtactaagacgaacgtacgtggcgtgtcgaccatcctgtcttctactcttcccgt

SEQ ID NO: 594987 - DNA, 486 bp, Homo sapiens; identical to SEQ ID NO: 535523
  misc_feature: HIJSMM301DLZGI.22.73.G07.1.454.light.4.raw

SEQ ID NO: 594988 - DNA, 478 bp, Homo sapiens; identical to SEQ ID NO: 549111
  misc_feature: HIJSMM301CXAU4.16.86.H09.1.454.light.4.raw

SEQ ID NO: 594989 - DNA, 454 bp, Homo sapiens
  misc_feature: HIJSMM301C5VUF.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggtggagggaccaagctgaccgtcctaagtcagcccaaggctgccccctcggtcactctgttcccaccctcctccacgagagta

SEQ ID NO: 594990 - DNA, 505 bp, Homo sapiens; identical to SEQ ID NO: 539978
  misc_feature: HIJSMM301AE8ER.5.86.H09.1.454.light.4.raw

SEQ ID NO: 594991 - DNA, 509 bp, Homo sapiens
  misc_feature: HIJSMM301CI6SI.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctcaagtctggcaacacggcctcctgaccatctctgggctccaggctgaggacgaggctgattattactgcagctcatatacaagcagcagcactcaagtcttcggaactgggaccaaggtccaccgtcctaggtcacgcccaaggcccaaccccactcgtcta

SEQ ID NO: 594992 - DNA, 502 bp, Homo sapiens
  misc_feature: HIJSMM301CZSC2.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactg

SEQ ID NO: 594993 - DNA, 504 bp, Homo sapiens
  misc_feature: HIJSMM301CT11Y.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggtgtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcc

SEQ ID NO: 594994 - DNA, 509 bp, Homo sapiens
  misc_feature: HIJSMM301BHHUF.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaaacaaactttcctggacacctgcccgattctcaggctccctccttgggggcaaagctgccctgaccctttcgggtgcgcagcctgaggatgaggctgactattactgcttgctcgcctatgatgctgctcgggtttcggcggaggaccaagttgaccgtcctaggtcagcccaaggcctcgccccctcggtcactctgttccccaccctc

SEQ ID NO: 594995 - DNA, 521 bp, Homo sapiens; identical to SEQ ID NO: 538715
  misc_feature: HIJSMM301A66HM.27.23.C01.1.454.light.4.raw

SEQ ID NO: 594996 - DNA, 444 bp, Homo sapiens; identical to SEQ ID NO: 535192
  misc_feature: HIJSMM301C48AS.5.9.A09.1.454.light.4.raw

SEQ ID NO: 594997 - DNA, 497 bp, Homo sapiens; identical to SEQ ID NO: 545672
  misc_feature: HIJSMM301BS6I1.2.49.E05.1.454.light.4.raw

SEQ ID NO: 594998 - DNA, 508 bp, Homo sapiens
  misc_feature: HIJSMM301CIBV7.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacaaaacctggccaggctccccgactcctcatttatgatgcatccaaaagggtcgttggcatcccagccaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgcca

SEQ ID NO: 594999 - DNA, 486 bp, Homo sapiens; identical to SEQ ID NO: 535385
  misc_feature: HIJSMM301B4X78.19.71.G05.1.454.light.4.raw

SEQ ID NO: 595000 - DNA, 512 bp, Homo sapiens
  misc_feature: HIJSMM301CI5B6.17.33.C11.1.454.light.4.raw
  modified_base (499)..(499): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactcngttcccacctcct

SEQ ID NO: 595001 - DNA, 489 bp, Homo sapiens; identical to SEQ ID NO: 535139
  misc_feature: HIJSMM301CZBG8.14.55.E11.1.454.light.4.raw

SEQ ID NO: 595002 - DNA, 505 bp, Homo sapiens
  misc_feature: HIJSMM301AT40J.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggactgggaccaaggtccaccgtcctaggtcacgcccaaggcccaaccccactgtcc

SEQ ID NO: 595003 - DNA, 496 bp, Homo sapiens; identical to SEQ ID NO: 588150
  misc_feature: HIJSMM301DVOKO.3.1.A01.1.454.light.4.raw

SEQ ID NO: 595004 - DNA, 507 bp, Homo sapiens; identical to SEQ ID NO: 561702
  misc_feature: HIJSMM301BA0QO.5.24.C02.1.454.light.4.raw

SEQ ID NO: 595005 - DNA, 480 bp, Homo sapiens
  misc_feature: HIJSMM301CCJF6.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgctaacttacttttgtcaacaggctcagagtttcccgctcactttcggcggagggaccaaggtggagatcaaacgaactgtggctgca

SEQ ID NO: 595006 - DNA, 485 bp, Homo sapiens; identical to SEQ ID NO: 539315
  misc_feature: HIJSMM301AROWG.3.88.H11.1.454.light.4.raw

SEQ ID NO: 595007 - DNA, 491 bp, Homo sapiens
  misc_feature: HIJSMM301ATORY.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcactttttggccaggggaccaaactggatatcagacgaactgtggctgca

SEQ ID NO: 595008 - DNA, 507 bp, Homo sapiens
  misc_feature: HIJSMM301BJ14D.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgaggtattactgcttgctctcctatagtggtgttcgggtgttcggcggagggaccaagctgaccgtcctaggtcagcccaaggctgccccctcggtcactctgttcccgcctcctcgctacgtaga

SEQ ID NO: 595009 - DNA, 494 bp, Homo sapiens
  misc_feature: HIJSMM301AEA7T.46.35.D02.1.454.light.4.raw
  modified_base (469)..(469): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtggggtctgggacagacttcactctcaccatcagcagactggagcctgaagattttgcagtctattactgtcagcagtatggtcacgtccccaagaacttttggtccgagggaccgaagactggagganactaacgaaactagtggctgcacca

SEQ ID NO: 595010 - DNA, 521 bp, Homo sapiens
  misc_feature: HIJSMM301B640M.22.86.H09.1.454.light.4.raw
acatacgcgtcacgaccggtgctcgatttagtgctatagacttgggtttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactctgttccccg

SEQ ID NO: 595011 - DNA, 494 bp, Homo sapiens; identical to SEQ ID NO: 535276
  misc_feature: HIJSMM301B0QGK.16.6.A06.1.454.light.4.raw

SEQ ID NO: 595012 - DNA, 509 bp, Homo sapiens; identical to SEQ ID NO: 541168
  misc_feature: HIJSMM301AQ7LB.5.60.F05.1.454.light.4.raw

SEQ ID NO: 595013 - DNA, 422 bp, Homo sapiens; identical to SEQ ID NO: 447881
  misc_feature: HIJSMM301DNBN1.9.34.D01.1.454.light.4.raw

SEQ ID NO: 595014 - DNA, 486 bp, Homo sapiens; identical to SEQ ID NO: 537310
  misc_feature: HIJSMM301D6JLE.15.28.C06.1.454.light.4.raw

SEQ ID NO: 595015 - DNA, 494 bp, Homo sapiens; identical to SEQ ID NO: 534994
  misc_feature: HIJSMM301EK04G.27.78.H01.1.454.light.4.raw

SEQ ID NO: 595016 - DNA, 496 bp, Homo sapiens
  misc_feature: HIJSMM301CO14C.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaaactgtggctgcaccatctgtcttcatt

SEQ ID NO: 595017 - DNA, 497 bp, Homo sapiens; identical to SEQ ID NO: 545672
  misc_feature: HIJSMM301B51A3.2.49.E05.1.454.light.4.raw

SEQ ID NO: 595018 - DNA, 508 bp, Homo sapiens
  misc_feature: HIJSMM301C2D9V.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttgacgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactgtgctgcaccatctgtcttcta

SEQ ID NO: 595019 - DNA, 505 bp, Homo sapiens
  misc_feature: HIJSMM301CUT9E.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttagtcgggtgttcggcgggggaccaagctgaccgtcctaggtcacgcccaaggctcgccccctcggtccactcttccg

SEQ ID NO: 595020 - DNA, 499 bp, Homo sapiens
  misc_feature: HIJSMM301C200I.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggtagggaccaagctgaccgtcctaggtcagcccaaggctgccccccg

SEQ ID NO: 595021 - DNA, 509 bp, Homo sapiens; identical to SEQ ID NO: 547302
  misc_feature: HIJSMM301AVQNF.4.57.F02.1.454.light.4.raw

SEQ ID NO: 595022 - DNA, 512 bp, Homo sapiens
  misc_feature: HIJSMM301A0BF5.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacctccgacaaacgcccccaaactcatctatttttgaggtcactacgcgaccctcgacggggtccctgatcgcttctctggctccaagtctggcaacacggcctccctgaccgtctctgggctccaggctgaggatgaggctgattattactgcagctcatatgcaggcagcagcacgtccccatgtgatcgttcgggcggggggaccgaacgctcgaccgtccgtaggtcacgccgaac

SEQ ID NO: 595023 - DNA, 506 bp, Homo sapiens
  misc_feature: HIJSMM301DML11.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccgcctcc

SEQ ID NO: 595024 - DNA, 492 bp, Homo sapiens
  misc_feature: HIJSMM301B4TJG.40.40.D07.1.454.light.4.raw
tctagcgactcacgaccggtgctcgatttagtgatagagcgtaacaacagaggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtctaggtcagcccaagg

SEQ ID NO: 595025 - DNA, 499 bp, Homo sapiens; identical to SEQ ID NO: 537263
  misc_feature: HIJSMM301A9F9T.15.25.C03.1.454.light.4.raw

SEQ ID NO: 595026 - DNA, 444 bp, Homo sapiens; identical to SEQ ID NO: 541457
  misc_feature: HIJSMM301DTX77.7.18.B07.1.454.light.4.raw

SEQ ID NO: 595027 - DNA, 518 bp, Homo sapiens; identical to SEQ ID NO: 539372
  misc_feature: HIJSMM301AY2JX.7.86.H09.1.454.light.4.raw

SEQ ID NO: 595028 - DNA, 512 bp, Homo sapiens
  misc_feature: HIJSMM301AOQFD.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaaacatgggatgacaatctgaggcggttgggtgttcggacgggagggaaccaaaactgaccgtccgtaggtcagccccaa

SEQ ID NO: 595029 - DNA, 484 bp, Homo sapiens; identical to SEQ ID NO: 551212
  misc_feature: HIJSMM301AM9RH.3.10.A10.1.454.light.4.raw

SEQ ID NO: 595030 - DNA, 520 bp, Homo sapiens
  misc_feature: HIJSMM301A0FGW.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacgtcg

SEQ ID NO: 595031 - DNA, 493 bp, Homo sapiens
  misc_feature: HIJSMM301EUDSE.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcaatcatcattgtaatttcggtggagggaccaaggtggaggtcaaacgaactgtggctgcaccatctgtcttcatcc

SEQ ID NO: 595032 - DNA, 487 bp, Homo sapiens; identical to SEQ ID NO: 536986
  misc_feature: HIJSMM301EJJS8.3.12.B01.1.454.light.4.raw

SEQ ID NO: 595033 - DNA, 499 bp, Homo sapiens
  misc_feature: HIJSMM301C02X1.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagccaaggctggccccctcggtcact

SEQ ID NO: 595034 - DNA, 521 bp, Homo sapiens; identical to SEQ ID NO: 539470
  misc_feature: HIJSMM301BFTJ2.27.23.C01.1.454.light.4.raw

SEQ ID NO: 595035 - DNA, 484 bp, Homo sapiens; identical to SEQ ID NO: 566906
  misc_feature: HIJSMM301AM0ZH.8.49.E05.1.454.light.4.raw

SEQ ID NO: 595036 - DNA, 483 bp, Homo sapiens; identical to SEQ ID NO: 542254
  misc_feature: HIJSMM301EKMSN.22.6.A06.1.454.light.4.raw

SEQ ID NO: 595037 - DNA, 461 bp, Homo sapiens
  misc_feature: HIJSMM301AVJTH.51.9.A09.1.454.light.4.raw
cgatcgtatacacgaccggtgctcgatttagcgagacgcgcagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 595038 - DNA, 515 bp, Homo sapiens
  misc_feature: HIJSMM301D8FX6.15.86.H09.1.454.light.4.raw
  modified_base (426)..(426): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggngttcggcggagggaccaagctgaccgtcctaggtcagcccaaggctgccccctggtcactctgttccccaccctcctcgctacgtagac

SEQ ID NO: 595039 - DNA, 495 bp, Homo sapiens
  misc_feature: HIJSMM301E1UAD.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctctcagacgttcggccaagggaccaaggtggaaatcaaacgaactgtggctgcacc

SEQ ID NO: 595040 - DNA, 444 bp, Homo sapiens; identical to SEQ ID NO: 536685
  misc_feature: HIJSMM301C39S3.10.76.G10.1.454.light.4.raw

SEQ ID NO: 595041 - DNA, 509 bp, Homo sapiens
  misc_feature: HIJSMM301EVVS3.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggaggaccaagctgaccgtcctcggtcagcccaaggctgccccctcggt

SEQ ID NO: 595042 - DNA, 509 bp, Homo sapiens
  misc_feature: HIJSMM301DJ9WE.13.23.C01.1.454.light.4.raw
tcacgtactacacgaccggtgctcgatttagtacacgtgattagggattggggcagcttcggctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattaactgtgcagcatactatgacaccctgaatggtctttgggtgtttcggcggagggacccaagctgaccgtcctaggtcaggcccaaggt

SEQ ID NO: 595043 - DNA, 464 bp, Homo sapiens; identical to SEQ ID NO: 537111
  misc_feature: HIJSMM301BORB3.17.28.C06.1.454.light.4.raw

SEQ ID NO: 595044 - DNA, 486 bp, Homo sapiens; identical to SEQ ID NO: 537310
  misc_feature: HIJSMM301CJJVA.15.28.C06.1.454.light.4.raw

SEQ ID NO: 595045 - DNA, 489 bp, Homo sapiens; identical to SEQ ID NO: 557621
  misc_feature: HIJSMM301EVU5U.13.87.H10.1.454.light.4.raw

SEQ ID NO: 595046 - DNA, 496 bp, Homo sapiens; identical to SEQ ID NO: 538838
  misc_feature: HIJSMM301BCSGP.51.34.D01.1.454.light.4.raw

SEQ ID NO: 595047 - DNA, 492 bp, Homo sapiens
  misc_feature: HIJSMM301CCMLP.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcgagggacaacagtcacgttgaccatcagtggagtccaggcagaggacgaggctgactattattgtcaatcagcagacaacagtaatacttatctttattgtcttcggatcgtgggaccagggtccaccgtcctaggtcagcccaaggcccaacccca

SEQ ID NO: 595048 - DNA, 490 bp, Homo sapiens; identical to SEQ ID NO: 535234
  misc_feature: HIJSMM301C6G5H.17.21.B10.1.454.light.4.raw

SEQ ID NO: 595049 - DNA, 513 bp, Homo sapiens
  misc_feature: HIJSMM301EONEG.8.34.D01.1.454.light.4.raw
ctcgcgtgtccacgaccggtgctcgatttagatcgtctgtgttgggtttgggggaggaactgctcagttaggacccagagggaaccatggaagccccagctcggcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccgaaagtaggatatacaaacgaactagtggctgcaccatctgtcttcat

SEQ ID NO: 595050 - DNA, 506 bp, Homo sapiens; identical to SEQ ID NO: 534969
  misc_feature: HIJSMM301A9MDC.18.37.D04.1.454.light.4.raw

SEQ ID NO: 595051 - DNA, 482 bp, Homo sapiens
  misc_feature: HIJSMM301BO5N3.49.57.F02.1.454.light.4.raw
agtcgagagacacgaccggtgctcgatttagctcgatatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcgcggagggccagggtggagatcaaacg

SEQ ID NO: 595052 - DNA, 472 bp, Homo sapiens
  misc_feature: HIJSMM301BKYGD.49.4.A04.1.454.light.4.raw
agtcgagagacacgaccggtgctcgatttagagtagtgatcagggggtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccgaacggtggagatcaagcgaactgtggctgca

SEQ ID NO: 595053 - DNA, 506 bp, Homo sapiens
  misc_feature: HIJSMM301B1AMF.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggcctcgccccctcggtcact

SEQ ID NO: 595054 - DNA, 509 bp, Homo sapiens
  misc_feature: HIJSMM301B4ZWK.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggaggaccaagttgaccgtcctaggtcagcccaaggctcgccccctcggtcactctgtt

SEQ ID NO: 595055 - DNA, 504 bp, Homo sapiens
  misc_feature: HIJSMM301A510G.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccgccct

SEQ ID NO: 595056 - DNA, 526 bp, Homo sapiens
  misc_feature: HIJSMM301DC88H.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccgaaggtcaccgtcctaggtcagcccaacggccaaccccactcgtcactctgttcccgccctcctcccgttcg

SEQ ID NO: 595057 - DNA, 480 bp, Homo sapiens; identical to SEQ ID NO: 554465
  misc_feature: HIJSMM301CS8HO.52.5.A05.1.454.light.4.raw

SEQ ID NO: 595058 - DNA, 482 bp, Homo sapiens; identical to SEQ ID NO: 550464
  misc_feature: HIJSMM301AQ3IB.13.50.E06.1.454.light.4.raw

SEQ ID NO: 595059 - DNA, 490 bp, Homo sapiens; identical to SEQ ID NO: 555889
  misc_feature: HIJSMM301EC3NS.11.28.C06.1.454.light.4.raw

SEQ ID NO: 595060 - DNA, 455 bp, Homo sapiens; identical to SEQ ID NO: 535447
  misc_feature: HIJSMM301EC1SW.19.71.G05.1.454.light.4.raw

SEQ ID NO: 595061 - DNA, 511 bp, Homo sapiens
  misc_feature: HIJSMM301AVBL2.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgtcgccgacggacgaaggtaggaagtacgaaacgaactagtggcgtgcaccactctgtcttctatcttcccgccctact

SEQ ID NO: 595062 - DNA, 491 bp, Homo sapiens; identical to SEQ ID NO: 572216
  misc_feature: HIJSMM301BW2H7.26.78.H01.1.454.light.4.raw

SEQ ID NO: 595063 - DNA, 503 bp, Homo sapiens
  misc_feature: HIJSMM301A99O9.40.33.C11.1.454.light.4.raw
tctagcgactcacgaccggtgctcgattagagtgagctcgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctcgccccctc

SEQ ID NO: 595064 - DNA, 489 bp, Homo sapiens; identical to SEQ ID NO: 546040
  misc_feature: HIJSMM301A3Q6C.11.12.B01.1.454.light.4.raw

SEQ ID NO: 595065 - DNA, 498 bp, Homo sapiens
  misc_feature: HIJSMM301DAP6N.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaaatgtggctgcaccat

SEQ ID NO: 595066 - DNA, 515 bp, Homo sapiens
  misc_feature: HIJSMM301DIE5G.49.11.A11.1.454.light.4.raw
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcg

SEQ ID NO: 595067 - DNA, 491 bp, Homo sapiens; identical to SEQ ID NO: 535294
  misc_feature: HIJSMM301B76EU.16.68.G02.1.454.light.4.raw

SEQ ID NO: 595068 - DNA, 444 bp, Homo sapiens; identical to SEQ ID NO: 550016
  misc_feature: HIJSMM301EOGA5.14.76.G10.1.454.light.4.raw

SEQ ID NO: 595069 - DNA, 495 bp, Homo sapiens
  misc_feature: HIJSMM301AV3AV.10.60.F05.1.454.light.4.raw
  modified_base (468)..(468): a, c, t, g, unknown or other
catagtagtgcacgaccggtgctcgatttagtacgtcatcaggggaaaggggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctccaatgatgttggtggttatatctatgtctcctggtaccaacaacacgcaggcaaagcccccgaagtcatgatttatgatgtcagtaagcggccctcaggggtccctgaccgcttctctggctccaagtctggcaacacggcctcctgaccatctctggcctccaggctgaggatgaggctgactattattgctgctcatatgcaggccggacctggttccggtatgtcttcggaactgggaccncggtcaccgtcctaggtcagcccaagg

SEQ ID NO: 595070 - DNA, 496 bp, Homo sapiens
  misc_feature: HIJSMM301BF2X4.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttcctaatcgcttctctggctccagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 595071 - DNA, 444 bp, Homo sapiens
  misc_feature: HIJSMM301C751E.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctccagcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 595072 - DNA, 510 bp, Homo sapiens
  misc_feature: HIJSMM301A72JL.48.33.C11.1.454.light.4.raw
agtatacatacacgaccggtgctcgatttagagtgagctcgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaaatggccaccttgactatcaatgggcccgaggtggacggatgaggctgactactactgttcctcaacagacagtagtggtgatcgagggcgtgttcggcggaaggggaccaaaggctgaccgtcctaagtcagcccaaggctgccccctcggtcactctcg

SEQ ID NO: 595073 - DNA, 521 bp, Homo sapiens; identical to SEQ ID NO: 538715
  misc_feature: HIJSMM301AUSOY.27.23.C01.1.454.light.4.raw

SEQ ID NO: 595074 - DNA, 488 bp, Homo sapiens
  misc_feature: HIJSMM301EITVP.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctataccttttggccaggggaccaaagctggagatcacaggaactgtggctgcacc

SEQ ID NO: 595075 - DNA, 513 bp, Homo sapiens; identical to SEQ ID NO: 563195
  misc_feature: HIJSMM301DVLTD.43.23.C01.1.454.light.4.raw

SEQ ID NO: 595076 - DNA, 477 bp, Homo sapiens
  misc_feature: HIJSMM301CYLD9.5.36.D03.1.454.light.4.raw
  modified_base (463)..(463): a, c, t, g, unknown or other
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgtcggccgaacggacgaagaataagaaatanaaacgaacacgtgg

SEQ ID NO: 595077 - DNA, 508 bp, Homo sapiens
  misc_feature: HIJSMM301EBF91.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccaaggtggacctcaaacgaactgtggctggcaccatctgtcttcatccttcccgcc

SEQ ID NO: 595078 - DNA, 502 bp, Homo sapiens; identical to SEQ ID NO: 541501
  misc_feature: HIJSMM301CTLKQ.17.27.C05.1.454.light.4.raw

SEQ ID NO: 595079 - DNA, 493 bp, Homo sapiens
  misc_feature: HIJSMM301B09DT.5.57.F02.1.454.light.4.raw
  modified_base (473)..(473): a, c, t, g, unknown or other
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaacngtggctgcaccatctgtctt

SEQ ID NO: 595080 - DNA, 508 bp, Homo sapiens
  misc_feature: HIJSMM301DABVV.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagccaaggctgccccctc

SEQ ID NO: 595081 - DNA, 495 bp, Homo sapiens; identical to SEQ ID NO: 547558
  misc_feature: HIJSMM301CSBBE.16.86.H09.1.454.light.4.raw

SEQ ID NO: 595082 - DNA, 502 bp, Homo sapiens
  misc_feature: HIJSMM301D6EC7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccgaagggaccaaggtaggagtaatcagacggaactagtggctg

SEQ ID NO: 595083 - DNA, 485 bp, Homo sapiens; identical to SEQ ID NO: 536576
  misc_feature: HIJSMM301DU6VM.46.35.D02.1.454.light.4.raw

SEQ ID NO: 595084 - DNA, 499 bp, Homo sapiens
  misc_feature: HIJSMM301C725G.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgatttactactgctgctcatatgcaggtcgtatctcttatgtcttcggaactgggaccaaggtcaccgtcctaggtcagcccaaggccaacccc

SEQ ID NO: 595085 - DNA, 504 bp, Homo sapiens; identical to SEQ ID NO: 544859
  misc_feature: HIJSMM301B0Y2C.15.66.F11.1.454.light.4.raw

SEQ ID NO: 595086 - DNA, 520 bp, Homo sapiens
  misc_feature: HIJSMM301BZ5UJ.52.57.F02.1.454.light.4.raw
cgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtcctacgtcagcccaaggctgccccctggtcactctgttccccg

SEQ ID NO: 595087 - DNA, 486 bp, Homo sapiens; identical to SEQ ID NO: 535385
  misc_feature: HIJSMM301BWQSL.19.71.G05.1.454.light.4.raw

SEQ ID NO: 595088 - DNA, 494 bp, Homo sapiens; identical to SEQ ID NO: 535629
  misc_feature: HIJSMM301CBNSG.4.27.C05.1.454.light.4.raw

SEQ ID NO: 595089 - DNA, 502 bp, Homo sapiens
  misc_feature: HIJSMM301AVS23.52.86.H09.1.454.light.4.raw
cgcagtacgacacgaccggtgctcgatttagtgctatagacttgggtttgggcacgaccggtggattatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaaacagacaccattggtacttatgtcttcggaactgcgaccaaggtcaccgtcctgggt

SEQ ID NO: 595090 - DNA, 506 bp, Homo sapiens
  misc_feature: HIJSMM301D1U35.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcattttccccg

SEQ ID NO: 595091 - DNA, 503 bp, Homo sapiens
  misc_feature: HIJSMM301DZOLH.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctccctgaccatctctgggctccaggctgaggacgaggctgattattactgcagctcatatacaagcaccagcactctctatgtcttcggaactgggaccaaggtccaccgtctaggtcacgccaacggcccaacccc

SEQ ID NO: 595092 - DNA, 507 bp, Homo sapiens
  misc_feature: HIJSMM301BQ8TN.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaaggtggagatcaaacgaactgtggctgcaccatctgtt

SEQ ID NO: 595093 - DNA, 497 bp, Homo sapiens; identical to SEQ ID NO: 535764
  misc_feature: HIJSMM301BCLSV.22.20.B09.1.454.light.4.raw

SEQ ID NO: 595094 - DNA, 503 bp, Homo sapiens; identical to SEQ ID NO: 564434
  misc_feature: HIJSMM301A214H.15.86.H09.1.454.light.4.raw

SEQ ID NO: 595095 - DNA, 496 bp, Homo sapiens
  misc_feature: HIJSMM301BQXL2.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatacaaacgtaacg

SEQ ID NO: 595096 - DNA, 495 bp, Homo sapiens
  misc_feature: HIJSMM301CXKJG.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggaggaccaaggtgaccgtctaggtcagcccaagg

SEQ ID NO: 595097 - DNA, 494 bp, Homo sapiens
  misc_feature: HIJSMM301BRS3L.41.16.B05.1.454.light.4.raw
tctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtactacttttggccaggggaccaagctcgagatcaaacgaactgtggctgcaccatctgtcttcatcttcccg

SEQ ID NO: 595098 - DNA, 501 bp, Homo sapiens; identical to SEQ ID NO: 536142
  misc_feature: HIJSMM301BO4CB.15.1.A01.1.454.light.4.raw

SEQ ID NO: 595099 - DNA, 504 bp, Homo sapiens; identical to SEQ ID NO: 535561
  misc_feature: HIJSMM301CG5ZX.4.57.F02.1.454.light.4.raw

SEQ ID NO: 595100 - DNA, 492 bp, Homo sapiens
  misc_feature: HIJSMM301BU4B9.26.23.C01.1.454.light.4.raw
  modified_base (476)..(476): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatcgtgggacagaattcactctcaccatcagcgggctccagtctgaggactctgcaacttattactgccaacaatatgattatttattctccagcgttcggccaggggaccaagggtggaagtcaagcgaactgnggctgcaccatctgtt

SEQ ID NO: 595101 - DNA, 493 bp, Homo sapiens
  misc_feature: HIJSMM301C281Z.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgttcttcta

SEQ ID NO: 595102 - DNA, 517 bp, Homo sapiens
  misc_feature: HIJSMM301CMKWT.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctcgtccccccg

SEQ ID NO: 595103 - DNA, 488 bp, Homo sapiens; identical to SEQ ID NO: 545530
  misc_feature: HIJSMM301AQ17S.47.38.D05.1.454.light.4.raw

SEQ ID NO: 595104 - DNA, 486 bp, Homo sapiens; identical to SEQ ID NO: 536329
  misc_feature: HIJSMM301BZS2Q.21.4.A04.1.454.light.4.raw

SEQ ID NO: 595105 - DNA, 511 bp, Homo sapiens
  misc_feature: HIJSMM301BL39K.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccccactgtcactctcgttccccaccctccc

SEQ ID NO: 595106 - DNA, 510 bp, Homo sapiens
  misc_feature: HIJSMM301BY71N.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccgggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccat

SEQ ID NO: 595107 - DNA, 486 bp, Homo sapiens; identical to SEQ ID NO: 535290
  misc_feature: HIJSMM301CIO2E.3.12.B01.1.454.light.4.raw

SEQ ID NO: 595108 - DNA, 465 bp, Homo sapiens; identical to SEQ ID NO: 555872
  misc_feature: HIJSMM301AJXN1.5.36.D03.1.454.light.4.raw

SEQ ID NO: 595109 - DNA, 444 bp, Homo sapiens; identical to SEQ ID NO: 534993
  misc_feature: HIJSMM301EVWKO.5.9.A09.1.454.light.4.raw

SEQ ID NO: 595110 - DNA, 497 bp, Homo sapiens
  misc_feature: HIJSMM301AQYJB.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacagcaccagcactctctatgtcttcggaactgggaccaggtccaccgtctaggtcacgcccaagga

SEQ ID NO: 595111 - DNA, 500 bp, Homo sapiens
  misc_feature: HIJSMM301BY36T.48.63.F08.1.454.light.4.raw
agtatacatacacgaccggtgctcgatttagcgatcgtataagggggagtcagacccacgtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggccctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggccagggggactaagctgagatcaaaccgaactgtggctgcacccatctgtcttccatcttccccg

SEQ ID NO: 595112 - DNA, 504 bp, Homo sapiens; identical to SEQ ID NO: 537659
  misc_feature: HIJSMM301CC4TY.13.55.E11.1.454.light.4.raw

SEQ ID NO: 595113 - DNA, 503 bp, Homo sapiens; identical to SEQ ID NO: 549080
  misc_feature: HIJSMM301DKS6D.53.49.E05.1.454.light.4.raw

SEQ ID NO: 595114 - DNA, 448 bp, Homo sapiens; identical to SEQ ID NO: 538166
  misc_feature: HIJSMM301B67JW.18.9.A09.1.454.light.4.raw

SEQ ID NO: 595115 - DNA, 505 bp, Homo sapiens
  misc_feature: HIJSMM301DLG9N.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaaagcccccaaactcatgatttatgaggtcactaagcggccctcaggggtccctgatcgcttctctggctccaagtctggcaacacggcctcctgaccgtctctgggctccaggctgaggatgaggctgattattactgctactcatatgcaggcggcaactcttgggtgttcggcggagggaccaagctgaccgtcctaggtcagcccaaggctcgccccctcggtcact

SEQ ID NO: 595116 - DNA, 487 bp, Homo sapiens
  misc_feature: HIJSMM301B3ZJK.49.46.E02.1.454.light.4.raw
agtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtgagatcaaacgaactgtggctgcacatctgt

SEQ ID NO: 595117 - DNA, 486 bp, Homo sapiens
  misc_feature: HIJSMM301EG766.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccatctgtt

SEQ ID NO: 595118 - DNA, 485 bp, Homo sapiens; identical to SEQ ID NO: 536075
  misc_feature: HIJSMM301DJ4GB.17.21.B10.1.454.light.4.raw

SEQ ID NO: 595119 - DNA, 487 bp, Homo sapiens
  misc_feature: HIJSMM301BN6ZB.40.36.D03.1.454.light.4.raw
  modified_base (378)..(378): a, c, t, g, unknown or other
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctgaagatgtggcagtttattactgtcaacaatattatattattccgaggacgttcggccaagggaccaaggtggaaatcaaacgaa

SEQ ID NO: 595120 - DNA, 495 bp, Homo sapiens
  misc_feature: HIJSMM301EY6N5.17.55.E11.1.454.light.4.raw
cgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcaagcagcctgcaggctgaagatgtggcagtttattactgtcagcaatattatagtactcctctcactttcggcggagggaccgaaggtggagatcaaacgaactagtgg

SEQ ID NO: 595121 - DNA, 481 bp, Homo sapiens
  misc_feature: HIJSMM301EIRTG.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctctgctcactttcggcggagggaccaaggtggagatcagacgaactgtggctgcacca

SEQ ID NO: 595122 - DNA, 518 bp, Homo sapiens
  misc_feature: HIJSMM301ATLCM.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccgaaggtgaccgtcctacgtcagcccaaggctcgccccctccggtcactctcgttcccaccctccct

SEQ ID NO: 595123 - DNA, 488 bp, Homo sapiens
  misc_feature: HIJSMM301DVHM7.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcactgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttaatctttatgtcttcggatctgggaccagggtcaccgtcctaggtcagcccaaggccaacccca

SEQ ID NO: 595124 - DNA, 501 bp, Homo sapiens
  misc_feature: HIJSMM301CMU44.15.56.F01.1.454.light.4.raw
  modified_base (484)..(484): a, c, t, g, unknown or other
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggtagggaccaagctgaccgtcctaggtcagcccaaggctgccccctcggtcactctgttcccncctcctcgctacgtaga

SEQ ID NO: 595125 - DNA, 486 bp, Homo sapiens; identical to SEQ ID NO: 535043
  misc_feature: HIJSMM301BL532.46.35.D02.1.454.light.4.raw

SEQ ID NO: 595126 - DNA, 542 bp, Homo sapiens
  misc_feature: HIJSMM301EWONX.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatagtgcgaggtcgtatctctttatcgttcttaccggaacgtcgggaaccgtaaggtaccgtacccgtaccgtaggtcgaacgacccgaaacggacccccaaacccctacgttcgtctacc

SEQ ID NO: 595127 - DNA, 503 bp, Homo sapiens
  misc_feature: HIJSMM301EFEL0.4.39.D06.1.454.light.4.raw
  modified_base (444)..(444): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatntgatattcggcggagggaccaaactgaaccgtcctaggtcagcccaagctgccccctcg

SEQ ID NO: 595128 - DNA, 497 bp, Homo sapiens
  misc_feature: HIJSMM301DHDCC.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggggaccaagctggagatcaaacgaactgtggctgcaccatctgt

SEQ ID NO: 595129 - DNA, 490 bp, Homo sapiens; identical to SEQ ID NO: 543909
  misc_feature: HIJSMM301EN8OO.14.55.E11.1.454.light.4.raw

SEQ ID NO: 595130 - DNA, 502 bp, Homo sapiens; identical to SEQ ID NO: 541971
  misc_feature: HIJSMM301BG7ED.4.39.D06.1.454.light.4.raw

SEQ ID NO: 595131 - DNA, 499 bp, Homo sapiens; identical to SEQ ID NO: 537739
  misc_feature: HIJSMM301CT2NC.12.86.H09.1.454.light.4.raw

SEQ ID NO: 595132 - DNA, 484 bp, Homo sapiens; identical to SEQ ID NO: 535400
  misc_feature: HIJSMM301CI0QH.46.26.C04.1.454.light.4.raw

SEQ ID NO: 595133 - DNA, 499 bp, Homo sapiens
  misc_feature: HIJSMM301DYFN9.49.79.H02.1.454.light.4.raw
agtcgagagacacgaccggtgctcgatttagtgtcacacgaagggaaaggggggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggcccaggctccacgcacgctcatgtacgatacaaatagtcgctcttctggggtccctgatcgcttctctggctccatccttgggaacaaagctgccctcaccatcacgggggcccaggcagatgatgaatgtgattatactgtgtgctgtatctgggtgtggcttttcgtgttctgcggagggaccaagctgaccgtcctacgtcagcccaaggctgccccctc

SEQ ID NO: 595134 - DNA, 502 bp, Homo sapiens
  misc_feature: HIJSMM301BGLFS.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggccctgggaccaaagtggagatcaaacgaacctagtggctgcacc

SEQ ID NO: 595135 - DNA, 501 bp, Homo sapiens; identical to SEQ ID NO: 536142
  misc_feature: HIJSMM301AHULE.15.1.A01.1.454.light.4.raw

SEQ ID NO: 595136 - DNA, 492 bp, Homo sapiens; identical to SEQ ID NO: 587008
  misc_feature: HIJSMM301EVZRG.13.39.D06.1.454.light.4.raw

SEQ ID NO: 595137 - DNA, 515 bp, Homo sapiens
  misc_feature: HIJSMM301BUXYT.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcc

SEQ ID NO: 595138 - DNA, 497 bp, Homo sapiens
  misc_feature: HIJSMM301EO4U0.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggcctgccccctcggtcactctcg

SEQ ID NO: 595139 - DNA, 506 bp, Homo sapiens; identical to SEQ ID NO: 534969
  misc_feature: HIJSMM301CUEN9.18.37.D04.1.454.light.4.raw

SEQ ID NO: 595140 - DNA, 515 bp, Homo sapiens; identical to SEQ ID NO: 591048
  misc_feature: HIJSMM301CU7SY.16.66.F11.1.454.light.4.raw

SEQ ID NO: 595141 - DNA, 500 bp, Homo sapiens; identical to SEQ ID NO: 541872
  misc_feature: HIJSMM301APUCJ.48.82.H05.1.454.light.4.raw

SEQ ID NO: 595142 - DNA, 495 bp, Homo sapiens
  misc_feature: HIJSMM301DRC1Z.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtgaaatcaaacgaactgtggctgcacc

SEQ ID NO: 595143 - DNA, 447 bp, Homo sapiens; identical to SEQ ID NO: 535201
  misc_feature: HIJSMM301EHWUY.18.9.A09.1.454.light.4.raw

SEQ ID NO: 595144 - DNA, 477 bp, Homo sapiens
  misc_feature: HIJSMM301B0926.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggacaagctgacgtcctaagtcagacccg

SEQ ID NO: 595145 - DNA, 501 bp, Homo sapiens
  misc_feature: HIJSMM301AJ855.48.38.D05.1.454.light.4.raw
agtatacatacacgaccggtgctcgatttagtatctgatagttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcta

SEQ ID NO: 595146 - DNA, 505 bp, Homo sapiens; identical to SEQ ID NO: 586937
  misc_feature: HIJSMM301EW4YZ.9.53.E09.1.454.light.4.raw

SEQ ID NO: 595147 - DNA, 492 bp, Homo sapiens
  misc_feature: HIJSMM301BO6VM.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccgagggaccgaacggtggaaagtacaaacgaactagtggctgcacca

SEQ ID NO: 595148 - DNA, 493 bp, Homo sapiens
  misc_feature: HIJSMM301EB4RV.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcggtcggagggaccgaaggtggagagtacaacgaactacg

SEQ ID NO: 595149 - DNA, 494 bp, Homo sapiens; identical to SEQ ID NO: 536974
  misc_feature: HIJSMM301AMIP6.16.86.H09.1.454.light.4.raw

SEQ ID NO: 595150 - DNA, 504 bp, Homo sapiens; identical to SEQ ID NO: 535055
  misc_feature: HIJSMM301C9JSP.7.71.G05.1.454.light.4.raw

SEQ ID NO: 595151 - DNA, 484 bp, Homo sapiens; identical to SEQ ID NO: 550098
  misc_feature: HIJSMM301BY77G.26.78.H01.1.454.light.4.raw

SEQ ID NO: 595152 - DNA, 477 bp, Homo sapiens; identical to SEQ ID NO: 537678
  misc_feature: HIJSMM301BQ4LO.12.1.A01.1.454.light.4.raw

SEQ ID NO: 595153 - DNA, 484 bp, Homo sapiens; identical to SEQ ID NO: 535400
  misc_feature: HIJSMM301BPQWS.46.26.C04.1.454.light.4.raw

SEQ ID NO: 595154 - DNA, 504 bp, Homo sapiens
  misc_feature: HIJSMM301C5H08.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctcctggccatcagtgggctccagtctggggatgaggctgattattactgtgcaacatgggatgacagtctgaacgcaatggtgttcggcggagggaccaaggtggccgtcctaggtcagcccaaggctcgccccctcggtcact

SEQ ID NO: 595155 - DNA, 511 bp, Homo sapiens
  misc_feature: HIJSMM301EO22T.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcgggagggaccgaagctgaccgtcctaggtcagcccaaggctgccccctcggtcactctgtt

SEQ ID NO: 595156 - DNA, 509 bp, Homo sapiens; identical to SEQ ID NO: 536047
  misc_feature: HIJSMM301EVV3M.17.33.C11.1.454.light.4.raw

SEQ ID NO: 595157 - DNA, 501 bp, Homo sapiens
  misc_feature: HIJSMM301CA4SH.52.57.F02.1.454.light.4.raw
cgcagtacgacacgaccggtgctcgatttagctcgatatagttgggtttgggggaggaactgctcagttaggacccagacggaaccatggaagccccagcgcagcttctcttcctcctgctactctggctcccagatacccccgaatagattgtgttgacacagtctccagccaccctgtctttgtctccaggggaaagagccaccctctcctgcagggccagtcagggtgttaacagctactttccctggtaccgccagagacctggccaggctcccagactcctcatctctgatgcatctacttgggccactggcgtcccagccaggttcagtggcagtgggcctgggacagtcttcactctcgtcatcagcagcctagagcctgaagactttgcgctttattactgtcagcagtgttgcaactggcatttcggcggagggaccaaggtggagatcaaacgcaggaactgtggctgcacatctgtcttcatcttccccg

SEQ ID NO: 595158 - DNA, 506 bp, Homo sapiens
  misc_feature: HIJSMM301EFRPT.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcat

SEQ ID NO: 595159 - DNA, 513 bp, Homo sapiens
  misc_feature: HIJSMM301DGGFW.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaaacaatacttttgtcttcggaactgggaccaaggtcaccgtcctaggtcagcccaaggccaaccccactcgtcactctcg

SEQ ID NO: 595160 - DNA, 499 bp, Homo sapiens
  misc_feature: HIJSMM301BNN7H.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggggaccaaggctggagatcaaacgaactgtggctgcaccatctgtt

SEQ ID NO: 595161 - DNA, 491 bp, Homo sapiens; identical to SEQ ID NO: 535176
  misc_feature: HIJSMM301B2IGT.13.39.D06.1.454.light.4.raw

SEQ ID NO: 595162 - DNA, 487 bp, Homo sapiens; identical to SEQ ID NO: 544897
  misc_feature: HIJSMM301E04N2.46.35.D02.1.454.light.4.raw

SEQ ID NO: 595163 - DNA, 505 bp, Homo sapiens
  misc_feature: HIJSMM301AF9NO.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactatggctgcaccatctgtcttcatcttcccgccat

SEQ ID NO: 595164 - DNA, 496 bp, Homo sapiens
  misc_feature: HIJSMM301E3GCL.47.46.E02.1.454.light.4.raw
agctcacgtacacgaccggtgctcgatttagactcatctacaggggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagtttattactgtcagcagtatcataactggcccgctcaccttcggccaagggacacgactggagaataaacgaacgtagtggctgcaccactcttcg

SEQ ID NO: 595165 - DNA, 501 bp, Homo sapiens
  misc_feature: HIJSMM301CCKFE.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggctccctgaccatctctgggctccaggctgaagatcaggctgattattactgctgttcattttcaagttcctttttgtcttcggaactgggaccgaggtcaccgtcctaggtcagcccaaggccaacccactgtcta

SEQ ID NO: 595166 - DNA, 482 bp, Homo sapiens; identical to SEQ ID NO: 546483
  misc_feature: HIJSMM301ARZZ1.3.38.D05.1.454.light.4.raw

SEQ ID NO: 595167 - DNA, 507 bp, Homo sapiens; identical to SEQ ID NO: 573179
  misc_feature: HIJSMM301AQ1QD.10.27.C05.1.454.light.4.raw

SEQ ID NO: 595168 - DNA, 506 bp, Homo sapiens; identical to SEQ ID NO: 573372
  misc_feature: HIJSMM301DOIY7.19.78.H01.1.454.light.4.raw

SEQ ID NO: 595169 - DNA, 489 bp, Homo sapiens; identical to SEQ ID NO: 536013
  misc_feature: HIJSMM301DIT8T.26.23.C01.1.454.light.4.raw

SEQ ID NO: 595170 - DNA, 478 bp, Homo sapiens
  misc_feature: HIJSMM301BRCY6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagccctaagctcctaatctacgatgcgtctcatttgcagacacggggtcccaccaaggttcagcggaagtggatctgggacagtattttaatttcaccatcagcagcctccaacgtgatgatgttgcaacatactattgtcagcaatatgtattttgctcctccgagtgcctacgttttgggacggggggaccaagggtggacatcaaacgaa

SEQ ID NO: 595171 - DNA, 487 bp, Homo sapiens; identical to SEQ ID NO: 535583
  misc_feature: HIJSMM301EXRV2.22.73.G07.1.454.light.4.raw

SEQ ID NO: 595172 - DNA, 509 bp, Homo sapiens; identical to SEQ ID NO: 547302
  misc_feature: HIJSMM301A1R31.4.57.F02.1.454.light.4.raw

SEQ ID NO: 595173 - DNA, 487 bp, Homo sapiens
  misc_feature: HIJSMM301DI79B.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagtttattactgtcagcagtatcataactggccgctccaccttcggccaagggacacgactggagaataaacgaactgtggctgcaccat

SEQ ID NO: 595174 - DNA, 500 bp, Homo sapiens
  misc_feature: HIJSMM301EIBGS.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagtattttacactagaaaatcagcagaggtggaggctggaggtagtggtttgggtttattactgcatgacaagctctacaaactccttactactttggccacggggaccaagctaggagatacaaacgaact

SEQ ID NO: 595175 - DNA, 494 bp, Homo sapiens; identical to SEQ ID NO: 583727
  misc_feature: HIJSMM301EDBUI.10.79.H02.1.454.light.4.raw

SEQ ID NO: 595176 - DNA, 488 bp, Homo sapiens; identical to SEQ ID NO: 535990
  misc_feature: HIJSMM301DTZ8I.11.28.C06.1.454.light.4.raw

SEQ ID NO: 595177 - DNA, 497 bp, Homo sapiens; identical to SEQ ID NO: 534982
  misc_feature: HIJSMM301A1G57.26.80.H03.1.454.light.4.raw

SEQ ID NO: 595178 - DNA, 494 bp, Homo sapiens
  misc_feature: HIJSMM301BJ90B.48.44.D11.1.454.light.4.raw
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccacgatcaactgcaagtccagccagagtattttatacagctcctacaataagagcgacttagcttggtaccagcagaaaccaggacagcctcctaagttgctcatttactgggcatctaaccggcaatccggggtcctgaccgattcagtggcagcgggtctgggacacatttcgctttcaccatcagcagcctgcaggctgaggatgtggcagtttattactgtcagcaatattatactactccgtggactttcggccaagggaccaacggtggaaatcagacgaactgtggctgcaccat

SEQ ID NO: 595179 - DNA, 520 bp, Homo sapiens
  misc_feature: HIJSMM301EGP8J.19.80.H03.1.454.light.4.raw
  modified_base (375)..(375): a, c, t, g, unknown or other
  modified_base (381)..(381): a, c, t, g, unknown or other
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggccngtttcngcgcccaatggttgcaccgcaaagcggggacccagaccctggagcctcagttggaagcagccgatccagcctgcggagcctgtgggcaggtcagcccaaggctgccccctcggtcactctcgtcccaccctcctccacg

SEQ ID NO: 595180 - DNA, 517 bp, Homo sapiens
  misc_feature: HIJSMM301CMRXG.16.83.H06.1.454.light.4.raw
  modified_base (130)..(130): a, c, t, g, unknown or other
tgtactactccacgaccggtgctcgatttagatcacgtgcgtcgcggggagtctgggcctaaggaagcagcactggtggtgcctcagccatggcctggaccgttctcctcctcggcctcctctctcactncggggggacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcacgtcctaggtcagtccaaggccaacccactgtcactctgttcccaccct

SEQ ID NO: 595181 - DNA, 494 bp, Homo sapiens
  misc_feature: HIJSMM301AH1SZ.51.23.C01.1.454.light.4.raw
cgatcgtatacacgaccggtgctcgatttagtacacgtgattagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 595182 - DNA, 488 bp, Homo sapiens; identical to SEQ ID NO: 563263
  misc_feature: HIJSMM301C7ATX.4.36.D03.1.454.light.4.raw

SEQ ID NO: 595183 - DNA, 503 bp, Homo sapiens
  misc_feature: HIJSMM301EWMH0.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactg

SEQ ID NO: 595184 - DNA, 486 bp, Homo sapiens; identical to SEQ ID NO: 537310
  misc_feature: HIJSMM301COFPC.15.28.C06.1.454.light.4.raw

SEQ ID NO: 595185 - DNA, 519 bp, Homo sapiens
  misc_feature: HIJSMM301CYTIV.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatttgggacacaattcactctcaccatcgctgatctgcagcctgaagattttgcaacttactactgtcaacagagtttcagtgtcccccggacgtcggtccgaggaccgacacgagaatagagacgaactagtggcgtgtcgaccaacgtctcgtcgttcctactcttcccgtcccta

SEQ ID NO: 595186 - DNA, 486 bp, Homo sapiens
  misc_feature: HIJSMM301DY7SQ.3.77.G11.1.454.light.4.raw
  modified_base (414)..(414): a, c, t, g, unknown or other
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacngtacgatggccggcctccgtggacattcggccaaggtaccaaggtggacatcagacgaactgtggctgcacc

SEQ ID NO: 595187 - DNA, 454 bp, Homo sapiens; identical to SEQ ID NO: 534964
  misc_feature: HIJSMM301B7MM7.19.86.H09.1.454.light.4.raw

SEQ ID NO: 595188 - DNA, 447 bp, Homo sapiens; identical to SEQ ID NO: 535020
  misc_feature: HIJSMM301A4C1U.18.9.A09.1.454.light.4.raw

SEQ ID NO: 595189 - DNA, 498 bp, Homo sapiens; identical to SEQ ID NO: 547576
  misc_feature: HIJSMM301A1Y6G.12.37.D04.1.454.light.4.raw

SEQ ID NO: 595190 - DNA, 488 bp, Homo sapiens; identical to SEQ ID NO: 536861
  misc_feature: HIJSMM301B2H4G.12.88.H11.1.454.light.4.raw

SEQ ID NO: 595191 - DNA, 519 bp, Homo sapiens
  misc_feature: HIJSMM301BJXEC.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccaccctccttcc

SEQ ID NO: 595192 - DNA, 494 bp, Homo sapiens
  misc_feature: HIJSMM301CF93C.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaaggtggagatcaagcggaactgtggctgcaccatctgtcttcactcttcccg

SEQ ID NO: 595193 - DNA, 491 bp, Homo sapiens
  misc_feature: HIJSMM301AQX2W.52.27.C05.1.454.light.4.raw
cgcagtacgacacgaccggtgctcgatttagacgcgatcgaagggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgccccctc

SEQ ID NO: 595194 - DNA, 487 bp, Homo sapiens
  misc_feature: HIJSMM301CQH9T.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagccgggacccaggctatggatgaggctgactattactgtcgaggcgtgggacatcagcagtgagggttggttttcgggcgggagggaccaagctcgaccgtcctaagtcacgacccg

SEQ ID NO: 595195 - DNA, 493 bp, Homo sapiens; identical to SEQ ID NO: 539015
  misc_feature: HIJSMM301A2ZTE.27.78.H01.1.454.light.4.raw

SEQ ID NO: 595196 - DNA, 499 bp, Homo sapiens; identical to SEQ ID NO: 554872
  misc_feature: HIJSMM301DD5RI.7.5.A05.1.454.light.4.raw

SEQ ID NO: 595197 - DNA, 507 bp, Homo sapiens; identical to SEQ ID NO: 565303
  misc_feature: HIJSMM301D11S7.19.78.H01.1.454.light.4.raw

SEQ ID NO: 595198 - DNA, 513 bp, Homo sapiens; identical to SEQ ID NO: 586608
  misc_feature: HIJSMM301CA7UE.16.66.F11.1.454.light.4.raw

SEQ ID NO: 595199 - DNA, 507 bp, Homo sapiens
  misc_feature: HIJSMM301DBPVP.49.65.F10.1.454.light.4.raw
agtcgagagacacgaccggtgctcgatttagctacgctctaaggggctgggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctcgttcccaccct

SEQ ID NO: 595200 - DNA, 493 bp, Homo sapiens; identical to SEQ ID NO: 549803
  misc_feature: HIJSMM301BH8YY.13.56.F01.1.454.light.4.raw

SEQ ID NO: 595201 - DNA, 495 bp, Homo sapiens; identical to SEQ ID NO: 563808
  misc_feature: HIJSMM301B579D.40.57.F02.1.454.light.4.raw

SEQ ID NO: 595202 - DNA, 494 bp, Homo sapiens; identical to SEQ ID NO: 534992
  misc_feature: HIJSMM301ED6US.9.1.A01.1.454.light.4.raw

SEQ ID NO: 595203 - DNA, 479 bp, Homo sapiens
  misc_feature: HIJSMM301DQTG2.51.76.G10.1.454.light.4.raw
cgatcgtatacacgaccggtgctcgatttagtcactcatacaggggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaaggctggagatcaaacgaactgtggctgcacc

SEQ ID NO: 595204 - DNA, 508 bp, Homo sapiens; identical to SEQ ID NO: 552440
  misc_feature: HIJSMM301AG40M.5.24.C02.1.454.light.4.raw

SEQ ID NO: 595205 - DNA, 484 bp, Homo sapiens
  misc_feature: HIJSMM301CVG2V.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 595206 - DNA, 484 bp, Homo sapiens; identical to SEQ ID NO: 537878
  misc_feature: HIJSMM301B2JEG.17.34.D01.1.454.light.4.raw

SEQ ID NO: 595207 - DNA, 506 bp, Homo sapiens
  misc_feature: HIJSMM301AH0MS.5.59.F04.1.454.light.4.raw
atcagacacgcacgaccggtgctcgatttagtacacacacttagggattggggagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccgaagggaccgaaggtaggaatacaaacgaactagtggctgcaccatctgtcttcatcttccccg

SEQ ID NO: 595208 - DNA, 513 bp, Homo sapiens; identical to SEQ ID NO: 568633
  misc_feature: HIJSMM301B7IN1.8.71.G05.1.454.light.4.raw

SEQ ID NO: 595209 - DNA, 495 bp, Homo sapiens
  misc_feature: HIJSMM301CE191.3.78.H01.1.454.light.4.raw
agacgcactccacgaccggtgctcgatttagtgtgagtagtttgggtttggggagagccctggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcacc

SEQ ID NO: 595210 - DNA, 512 bp, Homo sapiens
  misc_feature: HIJSMM301CVXRP.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctcctaaccatctctgggctccagtttgaggacgagtctacttattactgcagttcctttaaattaggcgccactctcgtggttttcggcggaggcaccgaagtgaccgtcctcggtcagcccaaggctgccccctcggtcact

SEQ ID NO: 595211 - DNA, 472 bp, Homo sapiens
  misc_feature: HIJSMM301C4T0O.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccgaaggtggagatacaacgaa

SEQ ID NO: 595212 - DNA, 510 bp, Homo sapiens; identical to SEQ ID NO: 580663
  misc_feature: HIJSMM301EJDYC.53.62.F07.1.454.light.4.raw

SEQ ID NO: 595213 - DNA, 463 bp, Homo sapiens; identical to SEQ ID NO: 535062
  misc_feature: HIJSMM301BV2QR.11.73.G07.1.454.light.4.raw

SEQ ID NO: 595214 - DNA, 489 bp, Homo sapiens
  misc_feature: HIJSMM301B5M3P.5.23.C01.1.454.light.4.raw
atcagacacgcacgaccggtgctcgatttagtacacgtgattagggattgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagatttcactctcaccatcagtagtctacaacctgaagattttgcaacttactactgtcaacagagttacgatacccctccgctcactttcggcggaggaccaaggtggaggatcaaacgaactgtggctgcaccatctgtt

SEQ ID NO: 595215 - DNA, 504 bp, Homo sapiens; identical to SEQ ID NO: 555616
  misc_feature: HIJSMM301EU4O9.5.86.H09.1.454.light.4.raw

SEQ ID NO: 595216 - DNA, 489 bp, Homo sapiens; identical to SEQ ID NO: 535139
  misc_feature: HIJSMM301BPYD1.14.55.E11.1.454.light.4.raw

SEQ ID NO: 595217 - DNA, 489 bp, Homo sapiens; identical to SEQ ID NO: 575567
  misc_feature: HIJSMM301C0NG6.47.36.D03.1.454.light.4.raw

SEQ ID NO: 595218 - DNA, 523 bp, Homo sapiens
  misc_feature: HIJSMM301CEC3U.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtctacc

SEQ ID NO: 595219 - DNA, 491 bp, Homo sapiens; identical to SEQ ID NO: 536211
  misc_feature: HIJSMM301A0UH5.16.53.E09.1.454.light.4.raw

SEQ ID NO: 595220 - DNA, 486 bp, Homo sapiens; identical to SEQ ID NO: 535917
  misc_feature: HIJSMM301ADDYU.3.10.A10.1.454.light.4.raw

SEQ ID NO: 595221 - DNA, 495 bp, Homo sapiens
  misc_feature: HIJSMM301B5O4Q.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactctaagtgatcaccttcggccaagggacacgactggagattaaacgaactgtggctgcaccatctgtctta

SEQ ID NO: 595222 - DNA, 496 bp, Homo sapiens; identical to SEQ ID NO: 535423
  misc_feature: HIJSMM301AI32S.3.33.C11.1.454.light.4.raw

SEQ ID NO: 595223 - DNA, 499 bp, Homo sapiens
  misc_feature: HIJSMM301D1G4M.51.59.F04.1.454.light.4.raw
cgatcgtatacacgaccggtgctcgatttagtacacacacttagggattgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcttcg

SEQ ID NO: 595224 - DNA, 473 bp, Homo sapiens; identical to SEQ ID NO: 535262
  misc_feature: HIJSMM301CCKJU.8.67.G01.1.454.light.4.raw

SEQ ID NO: 595225 - DNA, 504 bp, Homo sapiens
  misc_feature: HIJSMM301C19R9.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcta

SEQ ID NO: 595226 - DNA, 493 bp, Homo sapiens; identical to SEQ ID NO: 543505
  misc_feature: HIJSMM301EJ1H0.10.77.G11.1.454.light.4.raw

SEQ ID NO: 595227 - DNA, 471 bp, Homo sapiens; identical to SEQ ID NO: 540579
  misc_feature: HIJSMM301CUUZU.3.82.H05.1.454.light.4.raw

SEQ ID NO: 595228 - DNA, 470 bp, Homo sapiens
  misc_feature: HIJSMM301D77OR.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgagattttgcaacttattactgtctacaagatcacaattatcctggacgttcggaccaaggaccaaggtggaatcaaacgaa

SEQ ID NO: 595229 - DNA, 511 bp, Homo sapiens; identical to SEQ ID NO: 546062
  misc_feature: HIJSMM301CBPM4.5.58.F03.1.454.light.4.raw

SEQ ID NO: 595230 - DNA, 514 bp, Homo sapiens; identical to SEQ ID NO: 570269
  misc_feature: HIJSMM301DII9F.17.33.C11.1.454.light.4.raw

SEQ ID NO: 595231 - DNA, 512 bp, Homo sapiens
  misc_feature: HIJSMM301DUJGU.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgattaatttctgggtgttcgggcggagggaccaaactgaccgtccgtaggtcagcccaaggctcgccccctcggtcacttcg

SEQ ID NO: 595232 - DNA, 486 bp, Homo sapiens; identical to SEQ ID NO: 535043
  misc_feature: HIJSMM301B3ZFO.46.35.D02.1.454.light.4.raw

SEQ ID NO: 595233 - DNA, 478 bp, Homo sapiens
  misc_feature: HIJSMM301BHU9K.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacacacctgcgtggttttgctgttcggcggcgggacc

SEQ ID NO: 595234 - DNA, 494 bp, Homo sapiens; identical to SEQ ID NO: 558639
  misc_feature: HIJSMM301EEMWT.21.27.C05.1.454.light.4.raw

SEQ ID NO: 595235 - DNA, 497 bp, Homo sapiens
  misc_feature: HIJSMM301EFUNK.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggcctccaggtcagggacaatggccaccttgactatcactgggacccagatggacgatgaaggtgactaccactgttattcgacagacagcagtggtagtcagggggtcttcggcggagggacgaagctgaccgtcctgagtcagccaaggctgccccctcggtcactctgtt

SEQ ID NO: 595236 - DNA, 483 bp, Homo sapiens
  misc_feature: HIJSMM301D2C9H.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccttcctcgctcgtaga

SEQ ID NO: 595237 - DNA, 483 bp, Homo sapiens
  misc_feature: HIJSMM301EO1Q7.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtactagttttggccaggggaccaagctggagatcaaaacgaa

SEQ ID NO: 595238 - DNA, 504 bp, Homo sapiens; identical to SEQ ID NO: 563936
  misc_feature: HIJSMM301B3MP9.18.59.F04.1.454.light.4.raw

SEQ ID NO: 595239 - DNA, 492 bp, Homo sapiens
  misc_feature: HIJSMM301DH90O.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaatcaaacgaactgtggctgcaccatctgtcttcta

SEQ ID NO: 595240 - DNA, 448 bp, Homo sapiens
  misc_feature: HIJSMM301A1LJ0.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggaatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 595241 - DNA, 489 bp, Homo sapiens; identical to SEQ ID NO: 535139
  misc_feature: HIJSMM301A17CH.14.55.E11.1.454.light.4.raw

SEQ ID NO: 595242 - DNA, 506 bp, Homo sapiens; identical to SEQ ID NO: 575506
  misc_feature: HIJSMM301DQ8UU.19.78.H01.1.454.light.4.raw

SEQ ID NO: 595243 - DNA, 490 bp, Homo sapiens; identical to SEQ ID NO: 572219
  misc_feature: HIJSMM301EE7KS.3.10.A10.1.454.light.4.raw

SEQ ID NO: 595244 - DNA, 514 bp, Homo sapiens
  misc_feature: HIJSMM301CZW33.52.57.F02.1.454.light.4.raw
cgcagtacgacacgaccggtgctcgatttagctcgatatagttgggtttgggtgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatggttggggtttattactgcatgcaaggtacacactggcctccgacgttcggccaagggaccaaggtaggaaatacaaacgaactagtggctcgcaccatctgtcttcatt

SEQ ID NO: 595245 - DNA, 493 bp, Homo sapiens; identical to SEQ ID NO: 535745
  misc_feature: HIJSMM301ENB1A.47.78.H01.1.454.light.4.raw

SEQ ID NO: 595246 - DNA, 495 bp, Homo sapiens; identical to SEQ ID NO: 535712
  misc_feature: HIJSMM301AY33P.27.78.H01.1.454.light.4.raw

SEQ ID NO: 595247 - DNA, 504 bp, Homo sapiens
  misc_feature: HIJSMM301EFRLH.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccagacaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 595248 - DNA, 502 bp, Homo sapiens
  misc_feature: HIJSMM301AGFN2.48.34.D01.1.454.light.4.raw
agtatacatacacgaccggtgctcgatttagatcgtctgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttcccg

SEQ ID NO: 595249 - DNA, 484 bp, Homo sapiens
  misc_feature: HIJSMM301DUK6Z.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtcccatcaaggttcagtggaagtggatctgggacagattttactttcaccatcagcagcctgcagcctgaagatattgcaacatattactgtctacaagatcacaattatcctgggacgttcggaccgaagggaccaaggtaggaaatcaaacgaactgtggctgcaccatt

SEQ ID NO: 595250 - DNA, 507 bp, Homo sapiens
  misc_feature: HIJSMM301BA530.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttcttatcctccgtggacgttcggccaagggaccagggtaggaaatcagacgaactggtggctgcaccat

SEQ ID NO: 595251 - DNA, 493 bp, Homo sapiens; identical to SEQ ID NO: 544835
  misc_feature: HIJSMM301EEFD6.43.29.C07.1.454.light.4.raw

SEQ ID NO: 595252 - DNA, 489 bp, Homo sapiens; identical to SEQ ID NO: 535139
  misc_feature: HIJSMM301EQ6W5.14.55.E11.1.454.light.4.raw

SEQ ID NO: 595253 - DNA, 500 bp, Homo sapiens
  misc_feature: HIJSMM301BV47S.41.38.D05.1.454.light.4.raw
tctatactatcacgaccggtgctcgatttagtatctgatagttgggtttgggggccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcgcggagggaccaaggttgagaccaaacgaactagtggctgcaccatctgtcttcatcttccccg

SEQ ID NO: 595254 - DNA, 490 bp, Homo sapiens; identical to SEQ ID NO: 549445
  misc_feature: HIJSMM301DRZTU.52.85.H08.1.454.light.4.raw

SEQ ID NO: 595255 - DNA, 494 bp, Homo sapiens; identical to SEQ ID NO: 543381
  misc_feature: HIJSMM301CI7HY.40.57.F02.1.454.light.4.raw

SEQ ID NO: 595256 - DNA, 464 bp, Homo sapiens; identical to SEQ ID NO: 568856
  misc_feature: HIJSMM301AY7AZ.11.73.G07.1.454.light.4.raw

SEQ ID NO: 595257 - DNA, 454 bp, Homo sapiens; identical to SEQ ID NO: 534964
  misc_feature: HIJSMM301CRPE0.19.86.H09.1.454.light.4.raw

SEQ ID NO: 595258 - DNA, 501 bp, Homo sapiens; identical to SEQ ID NO: 535746
  misc_feature: HIJSMM301C8IZ6.18.11.A11.1.454.light.4.raw

SEQ ID NO: 595259 - DNA, 485 bp, Homo sapiens
  misc_feature: HIJSMM301ES97C.47.60.F05.1.454.light.4.raw
  modified_base (460)..(460): a, c, t, g, unknown or other
agctcacgtacacgaccggtgctcgatttagtacgtcatcagggaaagggggagggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactgganattaaacgaactgtggctgcaccat

SEQ ID NO: 595260 - DNA, 504 bp, Homo sapiens; identical to SEQ ID NO: 555616
  misc_feature: HIJSMM301DSJ0Y.5.86.H09.1.454.light.4.raw

SEQ ID NO: 595261 - DNA, 506 bp, Homo sapiens
  misc_feature: HIJSMM301CSIB1.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggtagggaccaaggtgaccgtcctaggtcagccaaggctgccccctcggtcactcttcg

SEQ ID NO: 595262 - DNA, 485 bp, Homo sapiens; identical to SEQ ID NO: 539315
  misc_feature: HIJSMM301D9HH0.3.88.H11.1.454.light.4.raw

SEQ ID NO: 595263 - DNA, 508 bp, Homo sapiens
  misc_feature: HIJSMM301ALNAM.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctggaccaaggtggagatcaaacgaactagtggctgcaccatctgtcttcta

SEQ ID NO: 595264 - DNA, 489 bp, Homo sapiens; identical to SEQ ID NO: 536663
  misc_feature: HIJSMM301D08EC.16.72.G06.1.454.light.4.raw

SEQ ID NO: 595265 - DNA, 475 bp, Homo sapiens
  misc_feature: HIJSMM301B1IW4.51.47.E03.1.454.light.4.raw
cgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagcccg

SEQ ID NO: 595266 - DNA, 494 bp, Homo sapiens; identical to SEQ ID NO: 534992
  misc_feature: HIJSMM301D6HSP.9.1.A01.1.454.light.4.raw

SEQ ID NO: 595267 - DNA, 491 bp, Homo sapiens
  misc_feature: HIJSMM301CN5FS.4.54.E10.1.454.light.4.raw
  modified_base (417)..(417): a, c, t, g, unknown or other
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagattttgcaactttactactgtcaaanagagttttcagttactcccttggactttcggaccgaagggaaccgaaggtaggaaagtacaaacgaactagtgg

SEQ ID NO: 595268 - DNA, 494 bp, Homo sapiens
  misc_feature: HIJSMM301BR78E.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaagg

SEQ ID NO: 595269 - DNA, 485 bp, Homo sapiens
  misc_feature: HIJSMM301BBWYF.21.25.C03.1.454.light.4.raw
  modified_base (391)..(391): a, c, t, g, unknown or other
tcgtcgctcgcacgaccggtgctcgatttagtagtgtagatttgggtttgggggctgttcctggaagttgctgataccagtgcacatcaaaaggtgactcgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcacgcctccctggtcntcgctgggctccaggctgacgatgaggctgattattattgccagtcctatgacaacacctgtcgtggttttggctgttcggcggcggaccaacg

SEQ ID NO: 595270 - DNA, 503 bp, Homo sapiens
  misc_feature: HIJSMM301D5A8Q.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatctccgtggctgcctctgtaggagacagagtcagcatcacttgtcggacgagtcaacatattagctggttaatttggtatcagcagaaagcaggaaaagcccctaacctcctgatcaagggtccgtcccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaaactgtggctgcaccatctgtcttcatcttcccgccta

SEQ ID NO: 595271 - DNA, 511 bp, Homo sapiens; identical to SEQ ID NO: 546062
  misc_feature: HIJSMM301DTVYU.5.58.F03.1.454.light.4.raw

SEQ ID NO: 595272 - DNA, 446 bp, Homo sapiens; identical to SEQ ID NO: 593773
  misc_feature: HIJSMM301BA5P2.18.9.A09.1.454.light.4.raw

SEQ ID NO: 595273 - DNA, 511 bp, Homo sapiens; identical to SEQ ID NO: 550438
  misc_feature: HIJSMM301BEQ7L.17.33.C11.1.454.light.4.raw

SEQ ID NO: 595274 - DNA, 494 bp, Homo sapiens
  misc_feature: HIJSMM301BFYHW.10.49.E05.1.454.light.4.raw
catagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccaccctgtctttgtctccaggggaaagagccaccctctcctgcagggccagtcagagcgttagcaactacttagcctggtaccaacagaaacctggccaggctcccaggctcctcatctatgatgtatccagccgggccactggcgtcccagccaggttcagtggcagtgggtctgggacagacttcactctcaccatcagcagcctagagcctgaagattttgcggtttattactgtcagcagcgtggccactggcctgcgttccctttcggccctgggaccaaagtggatatcaaacgactgtggctgcaccatctgt

SEQ ID NO: 595275 - DNA, 515 bp, Homo sapiens
  misc_feature: HIJSMM301CF6BE.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttccc

SEQ ID NO: 595276 - DNA, 494 bp, Homo sapiens; identical to SEQ ID NO: 534992
  misc_feature: HIJSMM301A6LT9.9.1.A01.1.454.light.4.raw

SEQ ID NO: 595277 - DNA, 454 bp, Homo sapiens; identical to SEQ ID NO: 536846
  misc_feature: HIJSMM301DICIU.18.78.H01.1.454.light.4.raw

SEQ ID NO: 595278 - DNA, 479 bp, Homo sapiens; identical to SEQ ID NO: 537186
  misc_feature: HIJSMM301DL0XZ.22.59.F04.1.454.light.4.raw

SEQ ID NO: 595279 - DNA, 509 bp, Homo sapiens
  misc_feature: HIJSMM301CMHHK.18.59.F04.1.454.light.4.raw
  modified_base (450)..(450): a, c, t, g, unknown or other
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatntcttcggaactgggaccaaggtcaccgtcctaggtcagcccaacgggcctaaccccacc

SEQ ID NO: 595280 - DNA, 492 bp, Homo sapiens
  misc_feature: HIJSMM301C2XS0.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtcaacaggctaacactttccccctcactttcggcggagggaccaaggtggagatcaagcgaactgtggctgcaccatctgtctt

SEQ ID NO: 595281 - DNA, 508 bp, Homo sapiens
  misc_feature: HIJSMM301BBAKC.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcgcggaggaccaagctgaccgtcctaagtcagccaaggctgccccctcggtcactctcg

SEQ ID NO: 595282 - DNA, 493 bp, Homo sapiens
  misc_feature: HIJSMM301DJ61R.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatacaaacgaactgtggctgcaccatctgtcttc

SEQ ID NO: 595283 - DNA, 479 bp, Homo sapiens
  misc_feature: HIJSMM301A7HNX.51.70.G04.1.454.light.4.raw
cgatcgtatacacgaccggtgctcgatttagtgtagtgtgaagggaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggacagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcgggcggagggacc

SEQ ID NO: 595284 - DNA, 513 bp, Homo sapiens; identical to SEQ ID NO: 535719
  misc_feature: HIJSMM301B4GSS.17.33.C11.1.454.light.4.raw

SEQ ID NO: 595285 - DNA, 493 bp, Homo sapiens; identical to SEQ ID NO: 535745
  misc_feature: HIJSMM301AL09R.47.78.H01.1.454.light.4.raw

SEQ ID NO: 595286 - DNA, 511 bp, Homo sapiens
  misc_feature: HIJSMM301B8Z9W.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttagtcagcccaaggctcgccccctcggtcactctcgttcccta

SEQ ID NO: 595287 - DNA, 481 bp, Homo sapiens
  misc_feature: HIJSMM301DYCK9.14.55.E11.1.454.light.4.raw
  modified_base (430)..(430): a, c, t, g, unknown or other
  modified_base (459)..(459): a, c, t, g, unknown or other
cgtctagtaccacgaccggtgctcgatttagcactcgcacgttgggtttggggaggtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaaagatttttgcaacttactactgtcaaacagattacagtacccccctnactttcggcggagggaccaaggcggagancagaagaactgtggctgcacca

SEQ ID NO: 595288 - DNA, 353 bp, Homo sapiens; identical to SEQ ID NO: 536338
  misc_feature: HIJSMM301ADY7M.3.11.A11.1.454.light.4.raw

SEQ ID NO: 595289 - DNA, 466 bp, Homo sapiens
  misc_feature: HIJSMM301DPBHZ.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcatcaacctgcagcctgaggatattgcaacatattactgtcaacaatatgataatctaccactcactttcggcggagggaccacggtggagatcaaacgaa

SEQ ID NO: 595290 - DNA, 444 bp, Homo sapiens; identical to SEQ ID NO: 535027
  misc_feature: HIJSMM301CKEM4.8.73.G07.1.454.light.4.raw

SEQ ID NO: 595291 - DNA, 492 bp, Homo sapiens
  misc_feature: HIJSMM301DCVJW.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcgggggtttactactgcatgcagggtacactctggccgttcacttttggcctaggggaccaaactggatatcagacgaactgtggctgca

SEQ ID NO: 595292 - DNA, 473 bp, Homo sapiens
  misc_feature: HIJSMM301DLPAP.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatacaaacgaactgtggctgcaccatctgtcttcatcttcccgccat

SEQ ID NO: 595293 - DNA, 514 bp, Homo sapiens
  misc_feature: HIJSMM301EU3GF.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccg

SEQ ID NO: 595294 - DNA, 478 bp, Homo sapiens
  misc_feature: HIJSMM301AW3F8.3.1.A01.1.454.light.4.raw
agacgcactccacgaccggtgctcgatttagacgtctcatcagggcacgaccggtgctcgatttagacgtctcatcagggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaag

SEQ ID NO: 595295 - DNA, 497 bp, Homo sapiens; identical to SEQ ID NO: 534982
  misc_feature: HIJSMM301BEQGE.26.80.H03.1.454.light.4.raw

SEQ ID NO: 595296 - DNA, 519 bp, Homo sapiens
  misc_feature: HIJSMM301CR3J8.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctcgccccctcggtcactctgttcccgccctcctccacg

SEQ ID NO: 595297 - DNA, 494 bp, Homo sapiens
  misc_feature: HIJSMM301E34Y3.10.53.E09.1.454.light.4.raw
  modified_base (481)..(481): a, c, t, g, unknown or other
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaaccccattcacattcggccctgggaccaaagtaggagatnaaaccgaactagt

SEQ ID NO: 595298 - DNA, 507 bp, Homo sapiens
  misc_feature: HIJSMM301EUFQ0.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgtcggccaaggaccgaaggtggaagtcaagcgaactgtggctgcaccatctgtcttcatcttcccgcc

SEQ ID NO: 595299 - DNA, 489 bp, Homo sapiens; identical to SEQ ID NO: 563369
  misc_feature: HIJSMM301EJAHQ.16.73.G07.1.454.light.4.raw

SEQ ID NO: 595300 - DNA, 484 bp, Homo sapiens; identical to SEQ ID NO: 550726
  misc_feature: HIJSMM301C5674.47.62.F07.1.454.light.4.raw

SEQ ID NO: 595301 - DNA, 487 bp, Homo sapiens; identical to SEQ ID NO: 536536
  misc_feature: HIJSMM301AU78P.26.45.E01.1.454.light.4.raw

SEQ ID NO: 595302 - DNA, 485 bp, Homo sapiens; identical to SEQ ID NO: 535880
  misc_feature: HIJSMM301BKO5S.7.75.G09.1.454.light.4.raw

SEQ ID NO: 595303 - DNA, 498 bp, Homo sapiens
  misc_feature: HIJSMM301DQSAM.8.75.G09.1.454.light.4.raw
ctcgcgtgtccacgaccggtgctcgatttagtatagacatcaggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaactaatactgtaaactggtaccagcaactcccaggaacggcccccaaactcctcatctatcatagtgatcagcggccctcaggggtccctgaccgattctctggctccaagtctgccacctcagcctccctggccatcagtgggctccagtctgaggatgaggctgattattactgtgcagcatgggatgacagcctgaatggcctggtattcggcggagggaccaaagtgaccgtcctaggtcagcccaaggctgtccccccg

SEQ ID NO: 595304 - DNA, 486 bp, Homo sapiens
  misc_feature: HIJSMM301EDVWD.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaaactgtggctgcaccat

SEQ ID NO: 595305 - DNA, 506 bp, Homo sapiens; identical to SEQ ID NO: 534969
  misc_feature: HIJSMM301C0BOH.18.37.D04.1.454.light.4.raw

SEQ ID NO: 595306 - DNA, 514 bp, Homo sapiens
  misc_feature: HIJSMM301B17J7.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcccta

SEQ ID NO: 595307 - DNA, 517 bp, Homo sapiens
  misc_feature: HIJSMM301D7ZM4.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacaggatcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccca

SEQ ID NO: 595308 - DNA, 483 bp, Homo sapiens; identical to SEQ ID NO: 553992
  misc_feature: HIJSMM301EFDVL.19.71.G05.1.454.light.4.raw

SEQ ID NO: 595309 - DNA, 444 bp, Homo sapiens; identical to SEQ ID NO: 535027
  misc_feature: HIJSMM301E1ICN.8.73.G07.1.454.light.4.raw

SEQ ID NO: 595310 - DNA, 485 bp, Homo sapiens; identical to SEQ ID NO: 538533
  misc_feature: HIJSMM301AWTWC.47.78.H01.1.454.light.4.raw

SEQ ID NO: 595311 - DNA, 447 bp, Homo sapiens; identical to SEQ ID NO: 535020
  misc_feature: HIJSMM301A6MZN.18.9.A09.1.454.light.4.raw

SEQ ID NO: 595312 - DNA, 484 bp, Homo sapiens; identical to SEQ ID NO: 535400
  misc_feature: HIJSMM301AHIFH.46.26.C04.1.454.light.4.raw

SEQ ID NO: 595313 - DNA, 465 bp, Homo sapiens; identical to SEQ ID NO: 549885
  misc_feature: HIJSMM301A0TRH.11.70.G04.1.454.light.4.raw

SEQ ID NO: 595314 - DNA, 488 bp, Homo sapiens; identical to SEQ ID NO: 538291
  misc_feature: HIJSMM301CYLZ2.19.71.G05.1.454.light.4.raw

SEQ ID NO: 595315 - DNA, 491 bp, Homo sapiens
  misc_feature: HIJSMM301EUHD8.40.81.H04.1.454.light.4.raw
tctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacc

SEQ ID NO: 595316 - DNA, 499 bp, Homo sapiens
  misc_feature: HIJSMM301BHU3E.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcactcccagacaggttcagtggcagtgggtctgggacagacttcactctcaccatcagcagactggagcctgaggtattttgcagtgtattactgtcagcagtatcataggtcaaacaccttcggaccaagggacacgactggagaattaaaggaacttgtggctgcaccatctgtcttcatcttccccg

SEQ ID NO: 595317 - DNA, 518 bp, Homo sapiens
  misc_feature: HIJSMM301BN7QM.40.27.C05.1.454.light.4.raw
  modified_base (201)..(201): a, c, t, g, unknown or other
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggnagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagccaaggctgccccctcggtcactctcg

SEQ ID NO: 595318 - DNA, 456 bp, Homo sapiens
  misc_feature: HIJSMM301BDNH5.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggttccggttttcggcggagggaccaagctgaccgtcctaagtcagcccaaggctcgcccctcggtcactctcgttcccgccctcctccacgagagta

SEQ ID NO: 595319 - DNA, 482 bp, Homo sapiens
  misc_feature: HIJSMM301DCEE0.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtcccatcaaggttcagtggaagtggatctgggacgtattttacttcaccatcatcaacctgcagctgagatattgcaacatattactgtcaacaatatgataatctaccactcactttcggcggagggaccacggtggagaatcaaacgaactgtggctgcaccatctgtcttcta

SEQ ID NO: 595320 - DNA, 509 bp, Homo sapiens
  misc_feature: HIJSMM301A6WYS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaggaccgaaggtggaagtacaaacgaactagtggctgcacatctgtcttctactcttcccgccctact

SEQ ID NO: 595321 - DNA, 519 bp, Homo sapiens; identical to SEQ ID NO: 540543
  misc_feature: HIJSMM301CWZVA.14.70.G04.1.454.light.4.raw

SEQ ID NO: 595322 - DNA, 501 bp, Homo sapiens
  misc_feature: HIJSMM301ED4OE.51.87.H10.1.454.light.4.raw
cgatcgtatacacgaccggtgctcgatttagcagtactgcgttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatatataagacgtctaatttagaaggtggggtcccatcaaggttcagcggcggtggctctgggacagaattcactctcaccatcaccagcctgcagcctgatgattttgcaacttattactgccaacagtattatagttattggacgttcggccaagggaccaaggtggaaagtacaaacgaactgtggctgcaccatctgtcttcatcttccccg

SEQ ID NO: 595323 - DNA, 499 bp, Homo sapiens
  misc_feature: HIJSMM301DC544.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 595324 - DNA, 516 bp, Homo sapiens; identical to SEQ ID NO: 580926
  misc_feature: HIJSMM301EILE3.8.43.D10.1.454.light.4.raw

SEQ ID NO: 595325 - DNA, 490 bp, Homo sapiens
  misc_feature: HIJSMM301BQ2AF.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcgccaggaccaaggtggaagtcaaacgaactgtggcgtcgcaccatctgtctt

SEQ ID NO: 595326 - DNA, 503 bp, Homo sapiens
  misc_feature: HIJSMM301BW153.18.78.H01.1.454.light.4.raw
  modified_base (497)..(497): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcaccgtcctaggtcagcccaaggccaacccnctgtca

SEQ ID NO: 595327 - DNA, 481 bp, Homo sapiens; identical to SEQ ID NO: 535993
  misc_feature: HIJSMM301D7LDL.21.25.C03.1.454.light.4.raw

SEQ ID NO: 595328 - DNA, 484 bp, Homo sapiens
  misc_feature: HIJSMM301BOL9P.41.78.H01.1.454.light.4.raw
tctatactatcacgaccggtgctcgatttagtgtgagtagtttgggtttggggtgatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcaggtcgggtggaggctgacgacgttgggacttattactgcgcgcaaagtctacaccttcctctcactttggccctgggaccaaagtggacatacaacgaa

SEQ ID NO: 595329 - DNA, 512 bp, Homo sapiens; identical to SEQ ID NO: 540108
  misc_feature: HIJSMM301BEISL.40.12.B01.1.454.light.4.raw

SEQ ID NO: 595330 - DNA, 484 bp, Homo sapiens
  misc_feature: HIJSMM301E2J9U.4.2.A02.1.454.light.4.raw
agcactgtagcacgaccggtgctcgatttagactcatctacaggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcacatctgtcttcta

SEQ ID NO: 595331 - DNA, 509 bp, Homo sapiens; identical to SEQ ID NO: 535670
  misc_feature: HIJSMM301EKOA1.47.23.C01.1.454.light.4.raw

SEQ ID NO: 595332 - DNA, 489 bp, Homo sapiens
  misc_feature: HIJSMM301CVB7X.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagacctatagtggtggcccgctcattttcggcggagggaccaaggtgcagatcaaacgaactgt

SEQ ID NO: 595333 - DNA, 502 bp, Homo sapiens
  misc_feature: HIJSMM301DDSZV.51.80.H03.1.454.light.4.raw
cgatcgtatacacgaccggtgctcgatttagctgtgcgtcgaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctcgccccccg

SEQ ID NO: 595334 - DNA, 479 bp, Homo sapiens; identical to SEQ ID NO: 560420
  misc_feature: HIJSMM301AHY17.48.28.C06.1.454.light.4.raw

SEQ ID NO: 595335 - DNA, 503 bp, Homo sapiens
  misc_feature: HIJSMM301AUMFV.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttccgccat

SEQ ID NO: 595336 - DNA, 485 bp, Homo sapiens; identical to SEQ ID NO: 535880
  misc_feature: HIJSMM301DAZ8A.7.75.G09.1.454.light.4.raw

SEQ ID NO: 595337 - DNA, 487 bp, Homo sapiens
  misc_feature: HIJSMM301C9SPE.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattatattacttcgtggacgttcggccaagggaccaaggtggataatcagacgaa

SEQ ID NO: 595338 - DNA, 494 bp, Homo sapiens; identical to SEQ ID NO: 534992
  misc_feature: HIJSMM301DLZM5.9.1.A01.1.454.light.4.raw

SEQ ID NO: 595339 - DNA, 493 bp, Homo sapiens; identical to SEQ ID NO: 538503
  misc_feature: HIJSMM301DT7SF.9.1.A01.1.454.light.4.raw

SEQ ID NO: 595340 - DNA, 447 bp, Homo sapiens; identical to SEQ ID NO: 535020
  misc_feature: HIJSMM301B21MR.18.9.A09.1.454.light.4.raw

SEQ ID NO: 595341 - DNA, 503 bp, Homo sapiens
  misc_feature: HIJSMM301BJGAH.27.78.H01.1.454.light.4.raw
  modified_base (493)..(493): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacctcaccatcaatagcctggaagctgaagatgctgcaacttatactgtcatcagagtactacttaccttcaagtgatcaccttcggccaagggacacgactgganatttaaaacg

SEQ ID NO: 595342 - DNA, 489 bp, Homo sapiens
  misc_feature: HIJSMM301A7FVM.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccgaaggcggagatcagacgaactgtggctgcaccatctgtcttct

SEQ ID NO: 595343 - DNA, 494 bp, Homo sapiens; identical to SEQ ID NO: 581151
  misc_feature: HIJSMM301BH84V.9.86.H09.1.454.light.4.raw

SEQ ID NO: 595344 - DNA, 489 bp, Homo sapiens; identical to SEQ ID NO: 536663
  misc_feature: HIJSMM301BKVG2.16.72.G06.1.454.light.4.raw

SEQ ID NO: 595345 - DNA, 481 bp, Homo sapiens
  misc_feature: HIJSMM301EXBV7.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaacggaccaacggtaggaaatacaaacgaaactgtggc

SEQ ID NO: 595346 - DNA, 508 bp, Homo sapiens; identical to SEQ ID NO: 550253
  misc_feature: HIJSMM301BI3VV.9.55.E11.1.454.light.4.raw

SEQ ID NO: 595347 - DNA, 494 bp, Homo sapiens; identical to SEQ ID NO: 534992
  misc_feature: HIJSMM301EZUR7.9.1.A01.1.454.light.4.raw

SEQ ID NO: 595348 - DNA, 494 bp, Homo sapiens; identical to SEQ ID NO: 534994
  misc_feature: HIJSMM301EYNIN.27.78.H01.1.454.light.4.raw

SEQ ID NO: 595349 - DNA, 485 bp, Homo sapiens; identical to SEQ ID NO: 535501
  misc_feature: HIJSMM301B41VU.3.10.A10.1.454.light.4.raw

SEQ ID NO: 595350 - DNA, 492 bp, Homo sapiens; identical to SEQ ID NO: 543155
  misc_feature: HIJSMM301D20KQ.10.53.E09.1.454.light.4.raw

SEQ ID NO: 595351 - DNA, 499 bp, Homo sapiens
  misc_feature: HIJSMM301C4REV.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagccaccctggccatcagtgggctccagtctggggatgaggctgattattactgtgcaacatgggatgacagtctgaacgcaatggtgttcggcggaggaccaaggtggccgtcctaggtcagcccaaggctgccccctcggt

SEQ ID NO: 595352 - DNA, 494 bp, Homo sapiens
  misc_feature: HIJSMM301EU9FC.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttactcggtctacaacatgataatttccctccgtggacgttcggccaagggaccaaggagcaaatcaaacgaactgtggctgcaccatctgtcttcatcttccgccat

SEQ ID NO: 595353 - DNA, 486 bp, Homo sapiens; identical to SEQ ID NO: 537127
  misc_feature: HIJSMM301C8ETY.3.77.G11.1.454.light.4.raw

SEQ ID NO: 595354 - DNA, 475 bp, Homo sapiens
  misc_feature: HIJSMM301AGOJV.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaacggtggacgatcaaacgaa

SEQ ID NO: 595355 - DNA, 506 bp, Homo sapiens; identical to SEQ ID NO: 543993
  misc_feature: HIJSMM301AYC5T.18.78.H01.1.454.light.4.raw

SEQ ID NO: 595356 - DNA, 472 bp, Homo sapiens
  misc_feature: HIJSMM301D5XGI.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcggggggaccaaggtggagatcaaacgaa

SEQ ID NO: 595357 - DNA, 505 bp, Homo sapiens
  misc_feature: HIJSMM301CRB4X.49.31.C09.1.454.light.4.raw
agtcgagagacacgaccggtgctcgatttagacgtctcatcaaggaaggaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtattcggcggagggaccaagctgaccgtcctaggtcagcccaaggctgccccctcggtcactctcg

SEQ ID NO: 595358 - DNA, 510 bp, Homo sapiens
  misc_feature: HIJSMM301DEQT2.10.27.C05.1.454.light.4.raw
catagtagtgcacgaccggtgctcgatttagacgcgatcgaagggtttggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggtttttcggcggaggggaccaggctgaccgtcctaagtcagcccaaggctgccccctcggt

SEQ ID NO: 595359 - DNA, 505 bp, Homo sapiens; identical to SEQ ID NO: 563271
  misc_feature: HIJSMM301AFW1C.2.21.B10.1.454.light.4.raw

SEQ ID NO: 595360 - DNA, 489 bp, Homo sapiens
  misc_feature: HIJSMM301BK7JK.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtcccatcaaggttcagcggcagtggatctgggacagaattcactctcactatcaccagcctgcaacctgatgattttgcaacttattactgccaacagtatcatcatcattgtaatttcggtggaggaccaaggtggaggtcaaacgaactgtggctgcaccatctgtcttcatt

SEQ ID NO: 595361 - DNA, 508 bp, Homo sapiens
  misc_feature: HIJSMM301EJTCL.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccccgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactctcg

SEQ ID NO: 595362 - DNA, 444 bp, Homo sapiens; identical to SEQ ID NO: 535594
  misc_feature: HIJSMM301ER6L3.9.9.A09.1.454.light.4.raw

SEQ ID NO: 595363 - DNA, 470 bp, Homo sapiens
  misc_feature: HIJSMM301DX3K3.41.76.G10.1.454.light.4.raw
tctatactatcacgaccggtgctcgatttagtcactcatacagggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcagagtattagtggctggttggcctggtatcagcagacaccagggaaagcccctaagctcctgatccataaggcatctaatttagaaagtggggtcccatcaaggttcagcggcagtggatctgggacagaattcactctcaccatcagcagcctgcagcctgatgattttgcaacttattactgccagcaatatcatagttctccttggacgttcggtccaagggaccaaggtaggacgatcaaacgaaa

SEQ ID NO: 595364 - DNA, 507 bp, Homo sapiens
  misc_feature: HIJSMM301BF5AP.15.59.F04.1.454.light.4.raw
tctacgtagccacgaccggtgctcgatttagtacacacacttagggattggggggaagcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 595365 - DNA, 503 bp, Homo sapiens
  misc_feature: HIJSMM301B6UP1.51.57.F02.1.454.light.4.raw
cgatcgtatacacgaccggtgctcgatttagctcgatatagttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaaactgtggctgcaccatctgtcttcta

SEQ ID NO: 595366 - DNA, 507 bp, Homo sapiens; identical to SEQ ID NO: 542586
  misc_feature: HIJSMM301A5TDY.8.33.C11.1.454.light.4.raw

SEQ ID NO: 595367 - DNA, 448 bp, Homo sapiens; identical to SEQ ID NO: 540364
  misc_feature: HIJSMM301B8PAQ.18.9.A09.1.454.light.4.raw

SEQ ID NO: 595368 - DNA, 508 bp, Homo sapiens; identical to SEQ ID NO: 550380
  misc_feature: HIJSMM301CWVC7.4.57.F02.1.454.light.4.raw

SEQ ID NO: 595369 - DNA, 508 bp, Homo sapiens
  misc_feature: HIJSMM301BEELC.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattattacttcgttggacgttcggtccgaacgggaaccgaacggtaggagtaatctagacgaactagtggcgtg

SEQ ID NO: 595370 - DNA, 512 bp, Homo sapiens; identical to SEQ ID NO: 541300
  misc_feature: HIJSMM301DLFO0.17.33.C11.1.454.light.4.raw

SEQ ID NO: 595371 - DNA, 362 bp, Homo sapiens; identical to SEQ ID NO: 586742
  misc_feature: HIJSMM301ASDQG.3.57.F02.1.454.light.4.raw

SEQ ID NO: 595372 - DNA, 514 bp, Homo sapiens; identical to SEQ ID NO: 538153
  misc_feature: HIJSMM301A9W3R.17.37.D04.1.454.light.4.raw

SEQ ID NO: 595373 - DNA, 506 bp, Homo sapiens
  misc_feature: HIJSMM301D74EQ.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactacaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaatcaacgaactgtggctgcaccatctgtctcat

SEQ ID NO: 595374 - DNA, 503 bp, Homo sapiens; identical to SEQ ID NO: 536760
  misc_feature: HIJSMM301AQNJ8.47.55.E11.1.454.light.4.raw

SEQ ID NO: 595375 - DNA, 486 bp, Homo sapiens; identical to SEQ ID NO: 536329
  misc_feature: HIJSMM301BZB6B.21.4.A04.1.454.light.4.raw

SEQ ID NO: 595376 - DNA, 508 bp, Homo sapiens
  misc_feature: HIJSMM301DEQCG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaaacgaactagtggctgcaccatctgtcttctatcttccccg

SEQ ID NO: 595377 - DNA, 480 bp, Homo sapiens; identical to SEQ ID NO: 557125
  misc_feature: HIJSMM301EJXQZ.48.28.C06.1.454.light.4.raw

SEQ ID NO: 595378 - DNA, 491 bp, Homo sapiens
  misc_feature: HIJSMM301B4EDQ.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgtt

SEQ ID NO: 595379 - DNA, 486 bp, Homo sapiens; identical to SEQ ID NO: 535043
  misc_feature: HIJSMM301A8LNZ.46.35.D02.1.454.light.4.raw

SEQ ID NO: 595380 - DNA, 521 bp, Homo sapiens
  misc_feature: HIJSMM301BYU5J.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcaggcccaaggcctgccccctcggtccactcctgttcccaccctcctccac

SEQ ID NO: 595381 - DNA, 497 bp, Homo sapiens; identical to SEQ ID NO: 536371
  misc_feature: HIJSMM301CBNG3.16.78.H01.1.454.light.4.raw

SEQ ID NO: 595382 - DNA, 491 bp, Homo sapiens; identical to SEQ ID NO: 537594
  misc_feature: HIJSMM301ENCR0.4.24.C02.1.454.light.4.raw

SEQ ID NO: 595383 - DNA, 495 bp, Homo sapiens
  misc_feature: HIJSMM301DU3MW.16.70.G04.1.454.light.4.raw
tgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcagtttattactgtcagcaatataatgactggcctcgctcactttcggcggagggaccaaggtggagatcaaacgaactgtggctgcaccatctgtcttcta

SEQ ID NO: 595384 - DNA, 504 bp, Homo sapiens; identical to SEQ ID NO: 558529
  misc_feature: HIJSMM301EE2YU.41.35.D02.1.454.light.4.raw

SEQ ID NO: 595385 - DNA, 510 bp, Homo sapiens
  misc_feature: HIJSMM301C8XYX.48.13.B02.1.454.light.4.raw
agtatacatacacgaccggtgctcgatttagtctagcgacttccgcgggggggctcagaagcagagttctggggtgtctccaccatggcctggacccctctctggctcactctcctcactctttgcataggctctgtggtttcttctgagctgactcaggaccctgctgtgtctgtggccttgggacagacggtcaggatcacatgccaaggagacagcctcagaaagttttctggaaactggtatcagcagaagccaggacaggcccctgttcttctcatctatggtgaaaatcaccggcccccagggatcccagaccgattctctggctctacctcaggagacacagcttccctgaccatcgctggggctcaggctgaagatgaggctgcctattattgtaactcccgggacagtagaggcgactattcctaatattcggcggagggaccaagttgaccgtcctaggtcagcccaaggctgccccctcggtcactctgttcccaccct

SEQ ID NO: 595386 - DNA, 492 bp, Homo sapiens; identical to SEQ ID NO: 535126
  misc_feature: HIJSMM301DRN4G.18.11.A11.1.454.light.4.raw

SEQ ID NO: 595387 - DNA, 516 bp, Homo sapiens; identical to SEQ ID NO: 547638
  misc_feature: HIJSMM301EMKWY.47.53.E09.1.454.light.4.raw

SEQ ID NO: 595388 - DNA, 514 bp, Homo sapiens
  misc_feature: HIJSMM301CW1SO.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcggccaaggaccaaggtgcaatcaaccgaactgtggctgcaccatctgtcttcatcttcccg

SEQ ID NO: 595389 - DNA, 489 bp, Homo sapiens
  misc_feature: HIJSMM301B7K0W.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtg

SEQ ID NO: 595390 - DNA, 510 bp, Homo sapiens; identical to SEQ ID NO: 537801
  misc_feature: HIJSMM301BI4SE.5.60.F05.1.454.light.4.raw

SEQ ID NO: 595391 - DNA, 486 bp, Homo sapiens; identical to SEQ ID NO: 535043
  misc_feature: HIJSMM301AGP15.46.35.D02.1.454.light.4.raw

SEQ ID NO: 595392 - DNA, 454 bp, Homo sapiens; identical to SEQ ID NO: 536325
  misc_feature: HIJSMM301BB1HG.19.86.H09.1.454.light.4.raw
  modified_base (436)..(436): a, c, t, g, unknown or other

SEQ ID NO: 595393 - DNA, 490 bp, Homo sapiens; identical to SEQ ID NO: 535865
  misc_feature: HIJSMM301CZOEH.5.11.A11.1.454.light.4.raw

SEQ ID NO: 595394 - DNA, 504 bp, Homo sapiens; identical to SEQ ID NO: 535495
  misc_feature: HIJSMM301AW6SC.14.86.H09.1.454.light.4.raw

SEQ ID NO: 595395 - DNA, 507 bp, Homo sapiens
  misc_feature: HIJSMM301B7JYA.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctaggctccagctcagggacagtggccaccttgactatcactggggcccaggtggaggatgaaggagactactattgttactctccagagaaggatggtcatcattgggtgttcggcggagggaccaaggctgaccgtcctaagtcagcccaaggctgccccctcggtcactctgttcccaccct

SEQ ID NO: 595396 - DNA, 482 bp, Homo sapiens; identical to SEQ ID NO: 535352
  misc_feature: HIJSMM301EJKBA.16.81.H04.1.454.light.4.raw

SEQ ID NO: 595397 - DNA, 480 bp, Homo sapiens; identical to SEQ ID NO: 547229
  misc_feature: HIJSMM301D7S09.12.10.A10.1.454.light.4.raw

SEQ ID NO: 595398 - DNA, 473 bp, Homo sapiens; identical to SEQ ID NO: 572401
  misc_feature: HIJSMM301BJ7M5.15.81.H04.1.454.light.4.raw

SEQ ID NO: 595399 - DNA, 490 bp, Homo sapiens; identical to SEQ ID NO: 535234
  misc_feature: HIJSMM301DH27H.17.21.B10.1.454.light.4.raw

SEQ ID NO: 595400 - DNA, 486 bp, Homo sapiens
  misc_feature: HIJSMM301ETVOF.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccgaaggtggagatcaaacgaact

SEQ ID NO: 595401 - DNA, 505 bp, Homo sapiens
  misc_feature: HIJSMM301BQDJA.5.68.G02.1.454.light.4.raw
  modified_base (219)..(219): a, c, t, g, unknown or other
  modified_base (492)..(492): a, c, t, g, unknown or other
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttanaagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccnccctcctccgtgt

SEQ ID NO: 595402 - DNA, 496 bp, Homo sapiens; identical to SEQ ID NO: 537249
  misc_feature: HIJSMM301CIWLC.16.78.H01.1.454.light.4.raw

SEQ ID NO: 595403 - DNA, 486 bp, Homo sapiens; identical to SEQ ID NO: 540808
  misc_feature: HIJSMM301BGHGM.26.70.G04.1.454.light.4.raw

SEQ ID NO: 595404 - DNA, 486 bp, Homo sapiens; identical to SEQ ID NO: 535043
  misc_feature: HIJSMM301BEHAS.46.35.D02.1.454.light.4.raw

SEQ ID NO: 595405 - DNA, 458 bp, Homo sapiens; identical to SEQ ID NO: 558145
  misc_feature: HIJSMM301CRFPI.10.86.H09.1.454.light.4.raw

SEQ ID NO: 595406 - DNA, 503 bp, Homo sapiens
  misc_feature: HIJSMM301C05SR.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgattcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 595407 - DNA, 498 bp, Homo sapiens
  misc_feature: HIJSMM301CZ9VI.51.59.F04.1.454.light.4.raw
cgatcgtatacacgaccggtgctcgatttagtacacacacttagggttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 595408 - DNA, 485 bp, Homo sapiens; identical to SEQ ID NO: 535606
  misc_feature: HIJSMM301C1DMB.47.46.E02.1.454.light.4.raw

SEQ ID NO: 595409 - DNA, 480 bp, Homo sapiens
  misc_feature: HIJSMM301B1H94.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggaggatcaatcgaa

SEQ ID NO: 595410 - DNA, 505 bp, Homo sapiens; identical to SEQ ID NO: 536254
  misc_feature: HIJSMM301A1ZGZ.7.71.G05.1.454.light.4.raw

SEQ ID NO: 595411 - DNA, 497 bp, Homo sapiens
  misc_feature: HIJSMM301C3NGM.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagcggcagcgggtctgggacagatttcactctcaccatcagcagcctgcaggctgaagatgtggcagtttattattgtcaacaatattattatacttcgtggacgttcggccaagggaccaaaggtggatatcagacgaactagtggctgca

SEQ ID NO: 595412 - DNA, 523 bp, Homo sapiens
  misc_feature: HIJSMM301CBLT9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggagggaccgaggctgaccgtcctaggtcagcccaaggctgccccctcggtcactctgttcccaccct

SEQ ID NO: 595413 - DNA, 502 bp, Homo sapiens; identical to SEQ ID NO: 557696
  misc_feature: HIJSMM301EFPW9.22.15.B04.1.454.light.4.raw

SEQ ID NO: 595414 - DNA, 469 bp, Homo sapiens
  misc_feature: HIJSMM301CBBNH.3.82.H05.1.454.light.4.raw
agacgcactccacgaccggtgctcgatttagtcgagctctctcgcgggggcaggagtcagacccagtcaggacacagcatggacatgagggtcccgctcagctcctggggctcctgctgctctggttcccaggttccagatgcgacatccagatgacccagtctccatcctccgtgtctgcatcgtgtaggggactagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagatttgcaacttactattgtcaacaggctgacagtctcccgctcactttcggcggaggacccaaggtggagatcaaacgaa

SEQ ID NO: 595415 - DNA, 496 bp, Homo sapiens; identical to SEQ ID NO: 538394
  misc_feature: HIJSMM301AVB08.22.86.H09.1.454.light.4.raw

SEQ ID NO: 595416 - DNA, 481 bp, Homo sapiens; identical to SEQ ID NO: 535993
  misc_feature: HIJSMM301ALFZZ.21.25.C03.1.454.light.4.raw

SEQ ID NO: 595417 - DNA, 492 bp, Homo sapiens
  misc_feature: HIJSMM301DOVA8.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccactcaacagcctgcagtctgaagattttgtcagtttattactgtcagcagtatcataactggccggctcaccttcggccaacgggacacgactggagattaaacgaaactacgtggctgcaccact

SEQ ID NO: 595418 - DNA, 478 bp, Homo sapiens; identical to SEQ ID NO: 535129
  misc_feature: HIJSMM301AMBSF.11.11.A11.1.454.light.4.raw

SEQ ID NO: 595419 - DNA, 488 bp, Homo sapiens; identical to SEQ ID NO: 537055
  misc_feature: HIJSMM301DVLIH.4.64.F09.1.454.light.4.raw

SEQ ID NO: 595420 - DNA, 510 bp, Homo sapiens
  misc_feature: HIJSMM301EQMJK.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgt

SEQ ID NO: 595421 - DNA, 497 bp, Homo sapiens
  misc_feature: HIJSMM301CRQKJ.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgatttataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgcgtct

SEQ ID NO: 595422 - DNA, 455 bp, Homo sapiens
  misc_feature: HIJSMM301APOT3.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaaagtcagcgcaaggctgccccctcggtcactctgttcccgccctcctccacgagagta

SEQ ID NO: 595423 - DNA, 490 bp, Homo sapiens
  misc_feature: HIJSMM301D5ZBP.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatgcctctcccccctacaactttcggtcaggggaccaagttgaacatcaatcgaactgtggctgcaccat

SEQ ID NO: 595424 - DNA, 505 bp, Homo sapiens; identical to SEQ ID NO: 571264
  misc_feature: HIJSMM301A1BYW.19.78.H01.1.454.light.4.raw

SEQ ID NO: 595425 - DNA, 494 bp, Homo sapiens; identical to SEQ ID NO: 535276
  misc_feature: HIJSMM301DSRYO.16.6.A06.1.454.light.4.raw

SEQ ID NO: 595426 - DNA, 501 bp, Homo sapiens
  misc_feature: HIJSMM301B6D2D.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagcaatattatattcctcctcagaccgttcggccaagggaccaaggtggaaatcaaaacgaactgtggctgcaccta

SEQ ID NO: 595427 - DNA, 499 bp, Homo sapiens; identical to SEQ ID NO: 560695
  misc_feature: HIJSMM301C9WJ1.2.34.D01.1.454.light.4.raw

SEQ ID NO: 595428 - DNA, 485 bp, Homo sapiens
  misc_feature: HIJSMM301BRLZG.52.87.H10.1.454.light.4.raw
cgcagtacgacacgaccggtgctcgatttagcagtactgcgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttggggtgttcgggcggagggaccaagttgaccgtctaggtcagcccaaggctcg

SEQ ID NO: 595429 - DNA, 485 bp, Homo sapiens
  misc_feature: HIJSMM301EY9MV.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccggtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 595430 - DNA, 488 bp, Homo sapiens; identical to SEQ ID NO: 542699
  misc_feature: HIJSMM301DSUA9.12.51.E07.1.454.light.4.raw

SEQ ID NO: 595431 - DNA, 522 bp, Homo sapiens; identical to SEQ ID NO: 541090
  misc_feature: HIJSMM301D1KG4.27.23.C01.1.454.light.4.raw

SEQ ID NO: 595432 - DNA, 495 bp, Homo sapiens; identical to SEQ ID NO: 555261
  misc_feature: HIJSMM301D1UA3.51.71.G05.1.454.light.4.raw

SEQ ID NO: 595433 - DNA, 506 bp, Homo sapiens
  misc_feature: HIJSMM301DCYGL.17.41.D08.1.454.light.4.raw
  modified_base (242)..(242): a, c, t, g, unknown or other
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactntttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 595434 - DNA, 517 bp, Homo sapiens
  misc_feature: HIJSMM301D55RT.7.71.G05.1.454.light.4.raw
  modified_base (205)..(205): a, c, t, g, unknown or other
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgctagtttattactgtcaacatcgtaccgagtcggccgtccgggggcctacgtttccggcccgtcgggaccaaaggtggatatacgaaacgaactgtggctgcaccatctgtctt

SEQ ID NO: 595435 - DNA, 479 bp, Homo sapiens
  misc_feature: HIJSMM301CCCG6.52.26.C04.1.454.light.4.raw
cgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctatcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaaggctgaccgtcctaggtcagcccaagg

SEQ ID NO: 595436 - DNA, 487 bp, Homo sapiens; identical to SEQ ID NO: 535704
  misc_feature: HIJSMM301EVB39.52.83.H06.1.454.light.4.raw

SEQ ID NO: 595437 - DNA, 487 bp, Homo sapiens
  misc_feature: HIJSMM301BMNVE.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgagggaccaaggcggagatcagacgaactgtggctgcaccatctgtcttca

SEQ ID NO: 595438 - DNA, 515 bp, Homo sapiens; identical to SEQ ID NO: 553367
  misc_feature: HIJSMM301B7ZL8.47.53.E09.1.454.light.4.raw

SEQ ID NO: 595439 - DNA, 493 bp, Homo sapiens; identical to SEQ ID NO: 535047
  misc_feature: HIJSMM301BIHM6.16.53.E09.1.454.light.4.raw

SEQ ID NO: 595440 - DNA, 505 bp, Homo sapiens
  misc_feature: HIJSMM301AN1B3.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagatcgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 595441 - DNA, 498 bp, Homo sapiens
  misc_feature: HIJSMM301ERAQ4.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactcgtcact

SEQ ID NO: 595442 - DNA, 497 bp, Homo sapiens; identical to SEQ ID NO: 545786
  misc_feature: HIJSMM301AO8EV.48.59.F04.1.454.light.4.raw

SEQ ID NO: 595443 - DNA, 502 bp, Homo sapiens
  misc_feature: HIJSMM301DZN5Q.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcacatct

SEQ ID NO: 595444 - DNA, 494 bp, Homo sapiens; identical to SEQ ID NO: 534994
  misc_feature: HIJSMM301CHUXA.27.78.H01.1.454.light.4.raw

SEQ ID NO: 595445 - DNA, 497 bp, Homo sapiens
  misc_feature: HIJSMM301EOJF2.40.35.D02.1.454.light.4.raw
tctagcgactcacgaccggtgctcgatttagcacacgatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctcg

SEQ ID NO: 595446 - DNA, 517 bp, Homo sapiens
  misc_feature: HIJSMM301E0WIZ.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactactttttatgttcgggactgggaccaaggtcaccgtcctaggtcagcccaaggccaaccccactgtcactcttccg

SEQ ID NO: 595447 - DNA, 494 bp, Homo sapiens; identical to SEQ ID NO: 534994
  misc_feature: HIJSMM301CWLV5.27.78.H01.1.454.light.4.raw

SEQ ID NO: 595448 - DNA, 498 bp, Homo sapiens; identical to SEQ ID NO: 546411
  misc_feature: HIJSMM301DTOJ0.48.59.F04.1.454.light.4.raw

SEQ ID NO: 595449 - DNA, 494 bp, Homo sapiens; identical to SEQ ID NO: 534992
  misc_feature: HIJSMM301D00XN.9.1.A01.1.454.light.4.raw

SEQ ID NO: 595450 - DNA, 448 bp, Homo sapiens
  misc_feature: HIJSMM301BK50K.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaacggccaacccctctgtcactctgttcccaccctcctccatactcgta

SEQ ID NO: 595451 - DNA, 507 bp, Homo sapiens
  misc_feature: HIJSMM301CFC2R.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctcgttccccg

SEQ ID NO: 595452 - DNA, 492 bp, Homo sapiens; identical to SEQ ID NO: 568489
  misc_feature: HIJSMM301A0BAZ.49.57.F02.1.454.light.4.raw

SEQ ID NO: 595453 - DNA, 503 bp, Homo sapiens
  misc_feature: HIJSMM301BI8Y3.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttagggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaaggtggatatcaaacgaactgtggctgcaccatctgtcttcatcttcccgccat

SEQ ID NO: 595454 - DNA, 441 bp, Homo sapiens; identical to SEQ ID NO: 534971
  misc_feature: HIJSMM301DQ558.11.3.A03.1.454.light.4.raw

SEQ ID NO: 595455 - DNA, 525 bp, Homo sapiens
  misc_feature: HIJSMM301D111E.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcggggcaaagctgccctgaccctaacgggggcgcagcctgaggacgaggccgactattattgcctactatcatttgatggtggtcgtctgcccattttcggcggcgggaccagggtggccgtcctgggtcagcccaaggctgccccctcggtcactctgttcccaccctcctcctagtctacg

SEQ ID NO: 595456 - DNA, 517 bp, Homo sapiens
  misc_feature: HIJSMM301BTLX4.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaaccccta

SEQ ID NO: 595457 - DNA, 447 bp, Homo sapiens; identical to SEQ ID NO: 535020
  misc_feature: HIJSMM301AKRUG.18.9.A09.1.454.light.4.raw

SEQ ID NO: 595458 - DNA, 490 bp, Homo sapiens
  misc_feature: HIJSMM301CHG0M.51.34.D01.1.454.light.4.raw
cgatcgtatacacgaccggtgctcgatttagatcgtctgtgttgggtttggggtggaagaacctgcccagcctgggcctcatgaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggggaccaagctgaccgtcctcggtcacg

SEQ ID NO: 595459 - DNA, 473 bp, Homo sapiens; identical to SEQ ID NO: 544382
  misc_feature: HIJSMM301CCPGV.11.76.G10.1.454.light.4.raw

SEQ ID NO: 595460 - DNA, 484 bp, Homo sapiens; identical to SEQ ID NO: 540581
  misc_feature: HIJSMM301EQK1W.3.88.H11.1.454.light.4.raw

SEQ ID NO: 595461 - DNA, 520 bp, Homo sapiens; identical to SEQ ID NO: 542144
  misc_feature: HIJSMM301CDNDS.48.24.C02.1.454.light.4.raw

SEQ ID NO: 595462 - DNA, 485 bp, Homo sapiens; identical to SEQ ID NO: 538533
  misc_feature: HIJSMM301EFZL4.47.78.H01.1.454.light.4.raw

SEQ ID NO: 595463 - DNA, 520 bp, Homo sapiens; identical to SEQ ID NO: 579367
  misc_feature: HIJSMM301AVJ04.27.23.C01.1.454.light.4.raw

SEQ ID NO: 595464 - DNA, 497 bp, Homo sapiens
  misc_feature: HIJSMM301CU8KN.51.12.B01.1.454.light.4.raw
cgatcgtatacacgaccggtgctcgatttagtagtgtagattccgcgggggctgtgggctcagaagcagagttctggggtgtctccaccatggcctggacccctctctggctcactctcctcactctttgcataggttctgtggtttcttctgagctgactcaggaccctactgtgtctgtggccttggggcagacagtcaggatcacatgccaaggagacaacctcagaatgttttatgcacactggtaccagcataagccaggacaggcccctctacttgtcatctatggtagagacaaccggccctcagggatcccagaccgattctctggctccatctcaggaaacacagcttccttgaccatcactggggctcaggcggaagatgaggctgactattactgtaatacccgggacagcagtgataaggtcatgatattcggcggagggacgaagctgaccgtcctacgtcagcccaaggctcgccccctcggt

SEQ ID NO: 595465 - DNA, 495 bp, Homo sapiens
  misc_feature: HIJSMM301B28PM.15.71.G05.1.454.light.4.raw
tctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctctcactttcggcggagggaccaaggtggatatctaaacgaactgtggctgcacca

SEQ ID NO: 595466 - DNA, 498 bp, Homo sapiens; identical to SEQ ID NO: 553891
  misc_feature: HIJSMM301B0V70.3.33.C11.1.454.light.4.raw

SEQ ID NO: 595467 - DNA, 506 bp, Homo sapiens; identical to SEQ ID NO: 543847
  misc_feature: HIJSMM301DBVFQ.21.87.H10.1.454.light.4.raw

SEQ ID NO: 595468 - DNA, 491 bp, Homo sapiens
  misc_feature: HIJSMM301B3GM7.14.53.E09.1.454.light.4.raw
cgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtctaggtcagccaaggctgccccctcggt

SEQ ID NO: 595469 - DNA, 494 bp, Homo sapiens
  misc_feature: HIJSMM301DT7PH.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctcactttcggcggtagggaccgagggtggagatcagacgaactgtggctgcacatctgtt

SEQ ID NO: 595470 - DNA, 521 bp, Homo sapiens; identical to SEQ ID NO: 539470
  misc_feature: HIJSMM301BIJY4.27.23.C01.1.454.light.4.raw

SEQ ID NO: 595471 - DNA, 495 bp, Homo sapiens
  misc_feature: HIJSMM301ERQ2A.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtaggtcacctggacttttggccaggggaccaagctggagatcaaacgaactgtggctgcaccatctgtctt

SEQ ID NO: 595472 - DNA, 446 bp, Homo sapiens; identical to SEQ ID NO: 538346
  misc_feature: HIJSMM301C15LM.18.9.A09.1.454.light.4.raw

SEQ ID NO: 595473 - DNA, 491 bp, Homo sapiens
  misc_feature: HIJSMM301AOMO6.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaagtggagatcaaacgaactgtgg

SEQ ID NO: 595474 - DNA, 454 bp, Homo sapiens; identical to SEQ ID NO: 534964
  misc_feature: HIJSMM301EV8Y9.19.86.H09.1.454.light.4.raw

SEQ ID NO: 595475 - DNA, 491 bp, Homo sapiens; identical to SEQ ID NO: 536549
  misc_feature: HIJSMM301BPWHH.47.55.E11.1.454.light.4.raw

SEQ ID NO: 595476 - DNA, 464 bp, Homo sapiens; identical to SEQ ID NO: 536640
  misc_feature: HIJSMM301DWBFE.26.78.H01.1.454.light.4.raw

SEQ ID NO: 595477 - DNA, 476 bp, Homo sapiens; identical to SEQ ID NO: 554798
  misc_feature: HIJSMM301CJ4Q5.48.2.A02.1.454.light.4.raw

SEQ ID NO: 595478 - DNA, 492 bp, Homo sapiens; identical to SEQ ID NO: 538317
  misc_feature: HIJSMM301EACFH.10.17.B06.1.454.light.4.raw

SEQ ID NO: 595479 - DNA, 490 bp, Homo sapiens; identical to SEQ ID NO: 543909
  misc_feature: HIJSMM301BS9UO.14.55.E11.1.454.light.4.raw

SEQ ID NO: 595480 - DNA, 503 bp, Homo sapiens
  misc_feature: HIJSMM301DYRN6.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggagggacccacctgaccgtcttaggtcagcccaaggctcgccccctcggtccta

SEQ ID NO: 595481 - DNA, 505 bp, Homo sapiens; identical to SEQ ID NO: 580812
  misc_feature: HIJSMM301DPDZW.2.35.D02.1.454.light.4.raw

SEQ ID NO: 595482 - DNA, 507 bp, Homo sapiens
  misc_feature: HIJSMM301ATRZQ.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccaaggaccgaaggtggaagtcaagcgaactgtggctgcaccatctgtcttcatcttcccgcc

SEQ ID NO: 595483 - DNA, 476 bp, Homo sapiens
  misc_feature: HIJSMM301EZO5C.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaggtcagaccccg

SEQ ID NO: 595484 - DNA, 506 bp, Homo sapiens
  misc_feature: HIJSMM301BJ2ER.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtca

SEQ ID NO: 595485 - DNA, 494 bp, Homo sapiens
  misc_feature: HIJSMM301A8DPI.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtcggagatacaaacgaactgtgg

SEQ ID NO: 595486 - DNA, 493 bp, Homo sapiens; identical to SEQ ID NO: 543929
  misc_feature: HIJSMM301AN36B.41.16.B05.1.454.light.4.raw

SEQ ID NO: 595487 - DNA, 473 bp, Homo sapiens; identical to SEQ ID NO: 535262
  misc_feature: HIJSMM301AT28K.8.67.G01.1.454.light.4.raw

SEQ ID NO: 595488 - DNA, 504 bp, Homo sapiens
  misc_feature: HIJSMM301BLDU8.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctggcccccc

SEQ ID NO: 595489 - DNA, 503 bp, Homo sapiens
  misc_feature: HIJSMM301CK0R8.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaagtggatatcaaacgaactagtggctgcacatctgtctt

SEQ ID NO: 595490 - DNA, 484 bp, Homo sapiens
  misc_feature: HIJSMM301CVREA.13.59.F04.1.454.light.4.raw
  modified_base (460)..(460): a, c, t, g, unknown or other
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggccccatctcggttcagtggcggtggatctaggacagaattcactctcaccatcaccaacctgcaccctgaagatgttggaagttattactgtcagacctatagtggtggcccgctcattttcggcggagggaccaaggtncagatcaaacgaactgtggctgca

SEQ ID NO: 595491 - DNA, 497 bp, Homo sapiens; identical to SEQ ID NO: 534982
  misc_feature: HIJSMM301AQ0ZU.26.80.H03.1.454.light.4.raw

SEQ ID NO: 595492 - DNA, 487 bp, Homo sapiens; identical to SEQ ID NO: 537220
  misc_feature: HIJSMM301BKSWZ.16.53.E09.1.454.light.4.raw

SEQ ID NO: 595493 - DNA, 502 bp, Homo sapiens; identical to SEQ ID NO: 541615
  misc_feature: HIJSMM301DMCRQ.21.26.C04.1.454.light.4.raw

SEQ ID NO: 595494 - DNA, 516 bp, Homo sapiens
  misc_feature: HIJSMM301C8RNT.40.12.B01.1.454.light.4.raw
tctagcgactcacgaccggtgctcgatttagtagtgtagattccgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggcctcgccccctcggtcactcttccg

SEQ ID NO: 595495 - DNA, 514 bp, Homo sapiens; identical to SEQ ID NO: 558677
  misc_feature: HIJSMM301EWTHC.15.76.G10.1.454.light.4.raw

SEQ ID NO: 595496 - DNA, 492 bp, Homo sapiens
  misc_feature: HIJSMM301BO2F7.49.17.B06.1.454.light.4.raw
agtcgagagacacgaccggtgctcgatttagtcgatagtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagccaaggctgccccctcggtcactc

SEQ ID NO: 595497 - DNA, 489 bp, Homo sapiens; identical to SEQ ID NO: 535139
  misc_feature: HIJSMM301D5EYM.14.55.E11.1.454.light.4.raw

SEQ ID NO: 595498 - DNA, 493 bp, Homo sapiens; identical to SEQ ID NO: 536769
  misc_feature: HIJSMM301ELYNT.19.83.H06.1.454.light.4.raw

SEQ ID NO: 595499 - DNA, 489 bp, Homo sapiens; identical to SEQ ID NO: 544582
  misc_feature: HIJSMM301BUU4F.22.65.F10.1.454.light.4.raw

SEQ ID NO: 595500 - DNA, 493 bp, Homo sapiens; identical to SEQ ID NO: 535084
  misc_feature: HIJSMM301A6Q1I.47.64.F09.1.454.light.4.raw

SEQ ID NO: 595501 - DNA, 485 bp, Homo sapiens; identical to SEQ ID NO: 542681
  misc_feature: HIJSMM301DX03J.40.83.H06.1.454.light.4.raw

SEQ ID NO: 595502 - DNA, 416 bp, Homo sapiens; identical to SEQ ID NO: 539343
  misc_feature: HIJSMM301BU0RS.18.78.H01.1.454.light.4.raw

SEQ ID NO: 595503 - DNA, 460 bp, Homo sapiens; identical to SEQ ID NO: 536053
  misc_feature: HIJSMM301BYT7R.22.28.C06.1.454.light.4.raw

SEQ ID NO: 595504 - DNA, 502 bp, Homo sapiens; identical to SEQ ID NO: 543442
  misc_feature: HIJSMM301EZ1Q6.8.42.D09.1.454.light.4.raw

SEQ ID NO: 595505 - DNA, 499 bp, Homo sapiens
  misc_feature: HIJSMM301BZMRX.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacacgtgttttcggcggagggaccaagctgaccgtcctaggtcagcccaaggctgccccccg

SEQ ID NO: 595506 - DNA, 507 bp, Homo sapiens
  misc_feature: HIJSMM301BPU2N.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctaggtcagcccaaggcctgccccctcggtccactctgttcccgccctcctctacgtcgtat

SEQ ID NO: 595507 - DNA, 502 bp, Homo sapiens; identical to SEQ ID NO: 536253
  misc_feature: HIJSMM301BAC0O.21.22.B11.1.454.light.4.raw

SEQ ID NO: 595508 - DNA, 504 bp, Homo sapiens
  misc_feature: HIJSMM301BGZX7.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccatgtca

SEQ ID NO: 595509 - DNA, 478 bp, Homo sapiens; identical to SEQ ID NO: 535129
  misc_feature: HIJSMM301BDVL3.11.11.A11.1.454.light.4.raw

SEQ ID NO: 595510 - DNA, 521 bp, Homo sapiens
  misc_feature: HIJSMM301A48P2.51.53.E09.1.454.light.4.raw
cgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggccaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactagaccgtcctacgtcagcccaaggctgccccctcggtcactctgttccccg

SEQ ID NO: 595511 - DNA, 505 bp, Homo sapiens; identical to SEQ ID NO: 594680
  misc_feature: HIJSMM301CMSGR.41.26.C04.1.454.light.4.raw

SEQ ID NO: 595512 - DNA, 485 bp, Homo sapiens; identical to SEQ ID NO: 535880
  misc_feature: HIJSMM301ATCGU.7.75.G09.1.454.light.4.raw

SEQ ID NO: 595513 - DNA, 487 bp, Homo sapiens; identical to SEQ ID NO: 541583
  misc_feature: HIJSMM301DAHHN.41.57.F02.1.454.light.4.raw

SEQ ID NO: 595514 - DNA, 486 bp, Homo sapiens
  misc_feature: HIJSMM301C4YXJ.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccagctgtagatgaggctgactattactgtcaggcgtggacagcagcactgaggtgttcggcggagggaccaagctgaccgtcctacgtcagcccaaggctgccccctc

SEQ ID NO: 595515 - DNA, 455 bp, Homo sapiens
  misc_feature: HIJSMM301DUDMC.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctccctccacgagagta

SEQ ID NO: 595516 - DNA, 496 bp, Homo sapiens
  misc_feature: HIJSMM301ETXV1.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggcccaaccccactgtcactctcg

SEQ ID NO: 595517 - DNA, 489 bp, Homo sapiens
  misc_feature: HIJSMM301B1D4G.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctcggtcactttcggcgggagggaccaaggtggagatcaaacgaactgtggctgcaccat

SEQ ID NO: 595518 - DNA, 514 bp, Homo sapiens; identical to SEQ ID NO: 546238
  misc_feature: HIJSMM301AMCI8.47.85.H08.1.454.light.4.raw

SEQ ID NO: 595519 - DNA, 488 bp, Homo sapiens
  misc_feature: HIJSMM301BJGM8.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaatgtggacagtccaaggatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 595520 - DNA, 505 bp, Homo sapiens
  misc_feature: HIJSMM301EM5J7.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccgaagctgaccgtcctaggtcagcccaacggctgccccctccggtcactctgttccccg

SEQ ID NO: 595521 - DNA, 482 bp, Homo sapiens; identical to SEQ ID NO: 557504
  misc_feature: HIJSMM301DSLXX.49.28.C06.1.454.light.4.raw

SEQ ID NO: 595522 - DNA, 486 bp, Homo sapiens; identical to SEQ ID NO: 535043
  misc_feature: HIJSMM301D197P.46.35.D02.1.454.light.4.raw

SEQ ID NO: 595523 - DNA, 485 bp, Homo sapiens; identical to SEQ ID NO: 535501
  misc_feature: HIJSMM301A896M.3.10.A10.1.454.light.4.raw

SEQ ID NO: 595524 - DNA, 505 bp, Homo sapiens
  misc_feature: HIJSMM301AZPKM.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtacttactttacctcaagtgatcaccttcggccaacggacacgactggagattaaaacg

SEQ ID NO: 595525 - DNA, 487 bp, Homo sapiens
  misc_feature: HIJSMM301CAIFF.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcgccaggggaccaaggtggaagtcaagcgaactgtggctgcaccatctgt

SEQ ID NO: 595526 - DNA, 488 bp, Homo sapiens
  misc_feature: HIJSMM301C0NXU.49.33.C11.1.454.light.4.raw
agtcgagagacacgaccggtgctcgatttagagtgagctcgttgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaaggtggagatcaaacgaactgtggctgcacatct

SEQ ID NO: 595527 - DNA, 493 bp, Homo sapiens; identical to SEQ ID NO: 536769
  misc_feature: HIJSMM301ETKDV.19.83.H06.1.454.light.4.raw

SEQ ID NO: 595528 - DNA, 484 bp, Homo sapiens; identical to SEQ ID NO: 550726
  misc_feature: HIJSMM301DRVE7.47.62.F07.1.454.light.4.raw

SEQ ID NO: 595529 - DNA, 491 bp, Homo sapiens; identical to SEQ ID NO: 544803
  misc_feature: HIJSMM301CQP5Y.21.9.A09.1.454.light.4.raw

SEQ ID NO: 595530 - DNA, 504 bp, Homo sapiens; identical to SEQ ID NO: 539083
  misc_feature: HIJSMM301D6C73.8.19.B08.1.454.light.4.raw

SEQ ID NO: 595531 - DNA, 485 bp, Homo sapiens
  misc_feature: HIJSMM301DOCCW.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcacatctgtcttcatt

SEQ ID NO: 595532 - DNA, 499 bp, Homo sapiens
  misc_feature: HIJSMM301EH8KU.48.83.H06.1.454.light.4.raw
  modified_base (230)..(230): a, c, t, g, unknown or other
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattggggganaaatatgtttgttggtatcaacagaagccaggccagtcccctgtattggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccg

SEQ ID NO: 595533 - DNA, 516 bp, Homo sapiens; identical to SEQ ID NO: 542229
  misc_feature: HIJSMM301BDHZZ.3.87.H10.1.454.light.4.raw

SEQ ID NO: 595534 - DNA, 503 bp, Homo sapiens
  misc_feature: HIJSMM301DVF6D.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggtaggcaccaaggtgaccgtcctaggtcagccaagctgcccctcggtca

SEQ ID NO: 595535 - DNA, 486 bp, Homo sapiens; identical to SEQ ID NO: 535458
  misc_feature: HIJSMM301ESV1L.7.75.G09.1.454.light.4.raw

SEQ ID NO: 595536 - DNA, 495 bp, Homo sapiens; identical to SEQ ID NO: 557386
  misc_feature: HIJSMM301EQ06R.27.78.H01.1.454.light.4.raw

SEQ ID NO: 595537 - DNA, 489 bp, Homo sapiens
  misc_feature: HIJSMM301BS4PB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaaccaaggtaggagtatcagacgaa

SEQ ID NO: 595538 - DNA, 498 bp, Homo sapiens
  misc_feature: HIJSMM301AD402.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattggggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgt

SEQ ID NO: 595539 - DNA, 490 bp, Homo sapiens
  misc_feature: HIJSMM301CVTR8.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatggtagctcaccgtacacttttggccaggggaccaagctggagatacaaacgaactgtggctgcaccatctgtcttcta

SEQ ID NO: 595540 - DNA, 505 bp, Homo sapiens
  misc_feature: HIJSMM301CNAG7.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaaggtaggaaagtacaaacgaactagtggctgcaccatctgtt

SEQ ID NO: 595541 - DNA, 507 bp, Homo sapiens
  misc_feature: HIJSMM301EEL1N.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctcaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcactctgtt

SEQ ID NO: 595542 - DNA, 511 bp, Homo sapiens
  misc_feature: HIJSMM301COV9D.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgacgtcctaggtcagccaaggctgccccctcggtcacgtctgtt

SEQ ID NO: 595543 - DNA, 491 bp, Homo sapiens
  misc_feature: HIJSMM301B44EU.51.71.G05.1.454.light.4.raw
cgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctggtcagcccaaggccaaccccactgtca

SEQ ID NO: 595544 - DNA, 518 bp, Homo sapiens
  misc_feature: HIJSMM301ECD3N.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaagctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctggtcactctgttcccaccct

SEQ ID NO: 595545 - DNA, 485 bp, Homo sapiens
  misc_feature: HIJSMM301DZOLV.5.45.E01.1.454.light.4.raw
atcagacacgcacgaccggtgctcgatttagtgagtcagtaagggaaagggggcaggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaagttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgtctttcccgcgcacgtttggccaggggaccaaggtgagatcaaacgaactgtggctgcacc

SEQ ID NO: 595546 - DNA, 506 bp, Homo sapiens
  misc_feature: HIJSMM301ALK8W.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcgggagggaccaaatagaggtacgaaacgaactagtggcgtgcaccatctgtcttcatt

SEQ ID NO: 595547 - DNA, 507 bp, Homo sapiens
  misc_feature: HIJSMM301COBWF.10.65.F10.1.454.light.4.raw
catagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaactggggaaagcccctacactcctgatcaatgcagcgtccagtttacagagtggggtcccctcaaggttcagtggcagtggatctgggacagactttactctcaccatcagcgatctgcagcctgacgtattttgcgtacttactactgtacaacagtacgtttcccggaaccccgtttacgtttcggcggagggaccaaggtggagatacaaacgaactggtgctgcaccatctgtcttcattccttcccgcta

SEQ ID NO: 595548 - DNA, 482 bp, Homo sapiens; identical to SEQ ID NO: 544665
  misc_feature: HIJSMM301BVAHV.8.14.B03.1.454.light.4.raw

SEQ ID NO: 595549 - DNA, 527 bp, Homo sapiens
  misc_feature: HIJSMM301CX0D5.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtccactcctcgttccccaccctt

SEQ ID NO: 595550 - DNA, 514 bp, Homo sapiens
  misc_feature: HIJSMM301ETEVK.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctaccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccct

SEQ ID NO: 595551 - DNA, 491 bp, Homo sapiens
  misc_feature: HIJSMM301BF7ZU.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagtaacttttggccgaggggaccaagcgtggagatacaaacgaactgtggctgcaccat

SEQ ID NO: 595552 - DNA, 502 bp, Homo sapiens; identical to SEQ ID NO: 573981
  misc_feature: HIJSMM301EV93B.19.67.G01.1.454.light.4.raw

SEQ ID NO: 595553 - DNA, 475 bp, Homo sapiens
  misc_feature: HIJSMM301CBEBH.11.73.G07.1.454.light.4.raw
cgagagataccacgaccggtgctcgatttagctctacgctcagggggcaggagtcagtcccaaccaggacacagcatggacatgggggtccctgctcagctcctggggctcctgctgctctgtctctcaggtgccagatgtgacatccagttgacccagtctccatcctccctgtctgcatctataggagacagagtcaccatcacttgcccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaactgtggctgca

SEQ ID NO: 595554 - DNA, 496 bp, Homo sapiens
  misc_feature: HIJSMM301B6RTF.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatcctgtcttcattcttccccg

SEQ ID NO: 595555 - DNA, 498 bp, Homo sapiens
  misc_feature: HIJSMM301D0PBK.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgagattttgcagtttattactgtcagcagtatgatacctggcctccgtacacttttggccgggggaccaagctggaaatcaagcgaactgtggctgcaccatctgtcttcatcttcccg

SEQ ID NO: 595556 - DNA, 485 bp, Homo sapiens; identical to SEQ ID NO: 536576
  misc_feature: HIJSMM301CEDVR.46.35.D02.1.454.light.4.raw

SEQ ID NO: 595557 - DNA, 493 bp, Homo sapiens; identical to SEQ ID NO: 537422
  misc_feature: HIJSMM301ANVQS.9.34.D01.1.454.light.4.raw

SEQ ID NO: 595558 - DNA, 507 bp, Homo sapiens
  misc_feature: HIJSMM301A9V0A.48.23.C01.1.454.light.4.raw
agtatacatacacgaccggtgctcgatttagtacacgtgattagggattgggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggccaagttgaccgtcctaggtcaaccaaggctgccccctc

SEQ ID NO: 595559 - DNA, 478 bp, Homo sapiens; identical to SEQ ID NO: 543315
  misc_feature: HIJSMM301AQN4W.26.72.G06.1.454.light.4.raw

SEQ ID NO: 595560 - DNA, 474 bp, Homo sapiens
  misc_feature: HIJSMM301CW94V.49.8.A08.1.454.light.4.raw
agtcgagagacacgaccggtgctcgatttagcatactctacaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcacttcggtcggacgggaaccaacggtggaggaatcaaacgaactgtgggctgca

SEQ ID NO: 595561 - DNA, 507 bp, Homo sapiens
  misc_feature: HIJSMM301AIEOH.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcact

SEQ ID NO: 595562 - DNA, 512 bp, Homo sapiens; identical to SEQ ID NO: 558821
  misc_feature: HIJSMM301CN7M1.7.34.D01.1.454.light.4.raw

SEQ ID NO: 595563 - DNA, 489 bp, Homo sapiens
  misc_feature: HIJSMM301BSQC4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatcctgtcttca

SEQ ID NO: 595564 - DNA, 486 bp, Homo sapiens; identical to SEQ ID NO: 535043
  misc_feature: HIJSMM301C5QNY.46.35.D02.1.454.light.4.raw

SEQ ID NO: 595565 - DNA, 498 bp, Homo sapiens
  misc_feature: HIJSMM301CIP85.48.82.H05.1.454.light.4.raw
agtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagccaaggctgccccctc

SEQ ID NO: 595566 - DNA, 507 bp, Homo sapiens; identical to SEQ ID NO: 549050
  misc_feature: HIJSMM301D8EKD.18.37.D04.1.454.light.4.raw

SEQ ID NO: 595567 - DNA, 447 bp, Homo sapiens; identical to SEQ ID NO: 535201
  misc_feature: HIJSMM301DQBNI.18.9.A09.1.454.light.4.raw

SEQ ID NO: 595568 - DNA, 486 bp, Homo sapiens; identical to SEQ ID NO: 546042
  misc_feature: HIJSMM301DNVL5.14.53.E09.1.454.light.4.raw

SEQ ID NO: 595569 - DNA, 504 bp, Homo sapiens; identical to SEQ ID NO: 564613
  misc_feature: HIJSMM301A5LBG.15.86.H09.1.454.light.4.raw

SEQ ID NO: 595570 - DNA, 494 bp, Homo sapiens; identical to SEQ ID NO: 534992
  misc_feature: HIJSMM301EM123.9.1.A01.1.454.light.4.raw

SEQ ID NO: 595571 - DNA, 485 bp, Homo sapiens; identical to SEQ ID NO: 551345
  misc_feature: HIJSMM301CMVJU.40.83.H06.1.454.light.4.raw

SEQ ID NO: 595572 - DNA, 508 bp, Homo sapiens
  misc_feature: HIJSMM301D9VOS.48.23.C01.1.454.light.4.raw
agtatacatacacgaccggtgctcgatttagtacacgtgattagggagttgggggaggaactgctcagttaggacccagacggaaccatggaagccccagcgcagcttctcttcctcctgctactctggctcccagattccactggacaaatagtgatgacgcagtccccagccaccctgtctgtgtctccgaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccagggaccaaggtggaagtcaaacgaactgtggctgcaccatctgtcttcatcttcccgccta

SEQ ID NO: 595573 - DNA, 513 bp, Homo sapiens; identical to SEQ ID NO: 546362
  misc_feature: HIJSMM301B10MH.16.66.F11.1.454.light.4.raw

SEQ ID NO: 595574 - DNA, 480 bp, Homo sapiens; identical to SEQ ID NO: 553480
  misc_feature: HIJSMM301C72HD.21.25.C03.1.454.light.4.raw

SEQ ID NO: 595575 - DNA, 503 bp, Homo sapiens
  misc_feature: HIJSMM301C76WM.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccatgtca

SEQ ID NO: 595576 - DNA, 510 bp, Homo sapiens; identical to SEQ ID NO: 535474
  misc_feature: HIJSMM301CTLGD.17.33.C11.1.454.light.4.raw

SEQ ID NO: 595577 - DNA, 484 bp, Homo sapiens; identical to SEQ ID NO: 538367
  misc_feature: HIJSMM301CBM7V.8.14.B03.1.454.light.4.raw

SEQ ID NO: 595578 - DNA, 494 bp, Homo sapiens; identical to SEQ ID NO: 534994
  misc_feature: HIJSMM301CBML4.27.78.H01.1.454.light.4.raw

SEQ ID NO: 595579 - DNA, 487 bp, Homo sapiens; identical to SEQ ID NO: 553173
  misc_feature: HIJSMM301AYIDA.46.35.D02.1.454.light.4.raw

SEQ ID NO: 595580 - DNA, 521 bp, Homo sapiens; identical to SEQ ID NO: 538715
  misc_feature: HIJSMM301BUK5J.27.23.C01.1.454.light.4.raw

SEQ ID NO: 595581 - DNA, 496 bp, Homo sapiens
  misc_feature: HIJSMM301BUDNK.27.78.H01.1.454.light.4.raw
agcgtcgtctcacgaccggtgctcgatttagtgtgagtagtttgggtttgggggatggagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 595582 - DNA, 481 bp, Homo sapiens
  misc_feature: HIJSMM301AH5QR.51.45.E01.1.454.light.4.raw
cgatcgtatacacgaccggtgctcgatttagtgagtcagtaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctcg

SEQ ID NO: 595583 - DNA, 513 bp, Homo sapiens
  misc_feature: HIJSMM301AJ1B6.43.23.C01.1.454.light.4.raw
tgtgagtagtcacgaccggtgctcgatttagtacacgtgattagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctcgccccctcggtcactctgttcccgccct

SEQ ID NO: 595584 - DNA, 495 bp, Homo sapiens; identical to SEQ ID NO: 547042
  misc_feature: HIJSMM301B0HTI.51.59.F04.1.454.light.4.raw

SEQ ID NO: 595585 - DNA, 507 bp, Homo sapiens
  misc_feature: HIJSMM301DX6DF.18.59.F04.1.454.light.4.raw
tacgagtatgcacgaccggtgctcgatttagtacacacacttagggagttgggggggggtctcagggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgtcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccta

SEQ ID NO: 595586 - DNA, 505 bp, Homo sapiens; identical to SEQ ID NO: 591956
  misc_feature: HIJSMM301BBEVI.14.57.F02.1.454.light.4.raw

SEQ ID NO: 595587 - DNA, 498 bp, Homo sapiens
  misc_feature: HIJSMM301EDS6Q.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctgttcttctatccttccccg

SEQ ID NO: 595588 - DNA, 509 bp, Homo sapiens
  misc_feature: HIJSMM301B5G9S.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtggatgacatcctgaatggtccggtgttcggcggagggaccaggctgaccgtcctaagtcagcccaaggctgccccctcc

SEQ ID NO: 595589 - DNA, 505 bp, Homo sapiens; identical to SEQ ID NO: 536233
  misc_feature: HIJSMM301CFX9S.48.25.C03.1.454.light.4.raw

SEQ ID NO: 595590 - DNA, 484 bp, Homo sapiens; identical to SEQ ID NO: 537399
  misc_feature: HIJSMM301EZETO.7.75.G09.1.454.light.4.raw

SEQ ID NO: 595591 - DNA, 465 bp, Homo sapiens; identical to SEQ ID NO: 542124
  misc_feature: HIJSMM301DS1E6.48.59.F04.1.454.light.4.raw

SEQ ID NO: 595592 - DNA, 485 bp, Homo sapiens; identical to SEQ ID NO: 535985
  misc_feature: HIJSMM301DVLFB.15.1.A01.1.454.light.4.raw

SEQ ID NO: 595593 - DNA, 505 bp, Homo sapiens
  misc_feature: HIJSMM301CTIB0.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgacccgtctctggctccagactgaggatgaggctgactattactgcagctcatttgcaggcagccgtatactcttcggcggaggaccaagctgaccgtctaggtcagcccaaggctcgccccctcggtctacc

SEQ ID NO: 595594 - DNA, 474 bp, Homo sapiens; identical to SEQ ID NO: 580149
  misc_feature: HIJSMM301C7OSF.7.81.H04.1.454.light.4.raw

SEQ ID NO: 595595 - DNA, 497 bp, Homo sapiens
  misc_feature: HIJSMM301CBFAL.9.21.B10.1.454.light.4.raw
tgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggcctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctcg

SEQ ID NO: 595596 - DNA, 500 bp, Homo sapiens; identical to SEQ ID NO: 586756
  misc_feature: HIJSMM301AHTM1.9.21.B10.1.454.light.4.raw

SEQ ID NO: 595597 - DNA, 506 bp, Homo sapiens; identical to SEQ ID NO: 537290
  misc_feature: HIJSMM301ASSDW.13.11.A11.1.454.light.4.raw

SEQ ID NO: 595598 - DNA, 507 bp, Homo sapiens
  misc_feature: HIJSMM301DKFKK.48.86.H09.1.454.light.4.raw
agtatacatacacgaccggtgctcgatttagtgctatagacttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgccta

SEQ ID NO: 595599 - DNA, 487 bp, Homo sapiens; identical to SEQ ID NO: 544897
  misc_feature: HIJSMM301ANAI9.46.35.D02.1.454.light.4.raw

SEQ ID NO: 595600 - DNA, 502 bp, Homo sapiens; identical to SEQ ID NO: 537816
  misc_feature: HIJSMM301CMHVV.19.78.H01.1.454.light.4.raw

SEQ ID NO: 595601 - DNA, 505 bp, Homo sapiens
  misc_feature: HIJSMM301DWFX4.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaagggtggaaatcaaacgaactgtggctgcaccatctgtcttcatcttcccg

SEQ ID NO: 595602 - DNA, 483 bp, Homo sapiens
  misc_feature: HIJSMM301AWA00.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccgaaggtggaaatacaaacgaactagtggtcgtgtcga

SEQ ID NO: 595603 - DNA, 500 bp, Homo sapiens
  misc_feature: HIJSMM301D3COV.21.22.B11.1.454.light.4.raw
  modified_base (415)..(415): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattacngtgcatcacgggacgcaacatgggatgacaatctgagcggttggtgttcggcggaggaccaaactgaccgtccaggtcagcccaa

SEQ ID NO: 595604 - DNA, 494 bp, Homo sapiens; identical to SEQ ID NO: 534992
  misc_feature: HIJSMM301C38F1.9.1.A01.1.454.light.4.raw

SEQ ID NO: 595605 - DNA, 487 bp, Homo sapiens; identical to SEQ ID NO: 541583
  misc_feature: HIJSMM301DUM0M.41.57.F02.1.454.light.4.raw

SEQ ID NO: 595606 - DNA, 374 bp, Homo sapiens
  misc_feature: HIJSMM301DJL5B.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttttggctgttcggcggcgggaccaagctgaccgtcctaggtcagcccaaggctgcccctcggtcactctgttcccgccctcctccgacgcgacga

SEQ ID NO: 595607 - DNA, 520 bp, Homo sapiens
  misc_feature: HIJSMM301CAJVN.10.86.H09.1.454.light.4.raw
catagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtctacgtcagcccaaggctgccccctcggtcact

SEQ ID NO: 595608 - DNA, 490 bp, Homo sapiens
  misc_feature: HIJSMM301EQQU8.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatct

SEQ ID NO: 595609 - DNA, 495 bp, Homo sapiens; identical to SEQ ID NO: 550605
  misc_feature: HIJSMM301CUJMF.41.38.D05.1.454.light.4.raw

SEQ ID NO: 595610 - DNA, 514 bp, Homo sapiens; identical to SEQ ID NO: 546238
  misc_feature: HIJSMM301CZIM1.47.85.H08.1.454.light.4.raw

SEQ ID NO: 595611 - DNA, 498 bp, Homo sapiens; identical to SEQ ID NO: 536879
  misc_feature: HIJSMM301B41H9.22.14.B03.1.454.light.4.raw

SEQ ID NO: 595612 - DNA, 500 bp, Homo sapiens
  misc_feature: HIJSMM301EA6HF.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgatgctgattattactgcaggtcatatacaatcagcaacacttatgtcttcgggactgggaccaagatcaccgtcctaggtcagcccaaggccaaccccactgt

SEQ ID NO: 595613 - DNA, 512 bp, Homo sapiens
  misc_feature: HIJSMM301EE1BY.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtcggaaatacaaacgaactagtggctgcaccatctgtctt

SEQ ID NO: 595614 - DNA, 511 bp, Homo sapiens; identical to SEQ ID NO: 573554
  misc_feature: HIJSMM301CFOZT.4.78.H01.1.454.light.4.raw

SEQ ID NO: 595615 - DNA, 497 bp, Homo sapiens; identical to SEQ ID NO: 535664
  misc_feature: HIJSMM301DRI7Z.22.14.B03.1.454.light.4.raw

SEQ ID NO: 595616 - DNA, 496 bp, Homo sapiens
  misc_feature: HIJSMM301AVYLB.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggtacacttttggccgggggaccgaagctggagatcaaacgaactgtggctgcaccatctgtcttcta

SEQ ID NO: 595617 - DNA, 383 bp, Homo sapiens; identical to SEQ ID NO: 447524
  misc_feature: HIJSMM301C7YIG.41.26.C04.1.454.light.4.raw

SEQ ID NO: 595618 - DNA, 507 bp, Homo sapiens
  misc_feature: HIJSMM301EAQUX.8.24.C02.1.454.light.4.raw
ctcgcgtgtccacgaccggtgctcgatttagtacagatcgttagggaaaggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggtaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctcggt

SEQ ID NO: 595619 - DNA, 507 bp, Homo sapiens; identical to SEQ ID NO: 535641
  misc_feature: HIJSMM301ATLSF.10.88.H11.1.454.light.4.raw

SEQ ID NO: 595620 - DNA, 495 bp, Homo sapiens; identical to SEQ ID NO: 545229
  misc_feature: HIJSMM301DR5WL.7.59.F04.1.454.light.4.raw

SEQ ID NO: 595621 - DNA, 494 bp, Homo sapiens; identical to SEQ ID NO: 534992
  misc_feature: HIJSMM301A58GO.9.1.A01.1.454.light.4.raw

SEQ ID NO: 595622 - DNA, 499 bp, Homo sapiens
  misc_feature: HIJSMM301BMA4G.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccgaagggaccgaacggtaggaaagtacaaacgaaacctagttgggcgttggcaccaa

SEQ ID NO: 595623 - DNA, 492 bp, Homo sapiens
  misc_feature: HIJSMM301AYNVD.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagccccaa

SEQ ID NO: 595624 - DNA, 372 bp, Homo sapiens
  misc_feature: HIJSMM301BIX5I.40.23.C01.1.454.light.4.raw
tctagcgactcacgaccggtgctcgatttagtacacgtgattagggattggggggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcacca

SEQ ID NO: 595625 - DNA, 502 bp, Homo sapiens; identical to SEQ ID NO: 541501
  misc_feature: HIJSMM301A1UY1.17.27.C05.1.454.light.4.raw

SEQ ID NO: 595626 - DNA, 489 bp, Homo sapiens
  misc_feature: HIJSMM301DLZWE.40.38.D05.1.454.light.4.raw
tctagcgactcacgaccggtgctcgatttagtatctgatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcacacggcctccctgaccatctctggctccagactgaggatgaggctacttattttgtctgctcttatgcaggcagtttcgctctcgaagtgttcggcggagggaccgagctgaccgtcctacgtcagccc

SEQ ID NO: 595627 - DNA, 497 bp, Homo sapiens
  misc_feature: HIJSMM301EC80X.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctgggaagagacttcactctcaccatcaacagcctagagcctgacgattctgcagtttattactgtcagcagcgtaccaagtggcctcgacttttggccaggggccaagctggagatcagacgaactgtggctgcaccatctgtcttcaatcttccccg

SEQ ID NO: 595628 - DNA, 502 bp, Homo sapiens; identical to SEQ ID NO: 541971
  misc_feature: HIJSMM301DNA1D.4.39.D06.1.454.light.4.raw

SEQ ID NO: 595629 - DNA, 505 bp, Homo sapiens
  misc_feature: HIJSMM301BYNXU.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccgaaggtgacccgtcctaacgtcacgcccaaggctcgccccctcggtcactcttccg

SEQ ID NO: 595630 - DNA, 501 bp, Homo sapiens
  misc_feature: HIJSMM301BOAMC.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagttattactgtcaacatcgtaccgagtggcctccgggggccacttcggccctggaccaagtggatatcaaacgaactgtggctgcaccatctgtctt

SEQ ID NO: 595631 - DNA, 454 bp, Homo sapiens; identical to SEQ ID NO: 534964
  misc_feature: HIJSMM301CREQJ.19.86.H09.1.454.light.4.raw

SEQ ID NO: 595632 - DNA, 495 bp, Homo sapiens
  misc_feature: HIJSMM301C9S6W.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 595633 - DNA, 514 bp, Homo sapiens
  misc_feature: HIJSMM301DX1DM.48.42.D09.1.454.light.4.raw
agtatacatacacgaccggtgctcgatttagacacatacgcagggaaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcggagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccct

SEQ ID NO: 595634 - DNA, 464 bp, Homo sapiens; identical to SEQ ID NO: 536640
  misc_feature: HIJSMM301DM1FJ.26.78.H01.1.454.light.4.raw

SEQ ID NO: 595635 - DNA, 499 bp, Homo sapiens
  misc_feature: HIJSMM301D2SBY.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaagggaccgaaggtggaaggtacaaacgaactagtggcgtgcgaccatctgtcttt

SEQ ID NO: 595636 - DNA, 490 bp, Homo sapiens; identical to SEQ ID NO: 536855
  misc_feature: HIJSMM301DX1FA.16.68.G02.1.454.light.4.raw

SEQ ID NO: 595637 - DNA, 524 bp, Homo sapiens
  misc_feature: HIJSMM301D72C9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcgtccgaacggaccgaacggtagggaagtacgaaacgaaacgtagtggcgtgcgaccactctgtcttctactcttcccgtccctact

SEQ ID NO: 595638 - DNA, 486 bp, Homo sapiens
  misc_feature: HIJSMM301B9MHC.43.4.A04.1.454.light.4.raw
tgtgagtagtcacgaccggtgctcgatttagagtagtgatcaggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggacatcaaacgaactagtggctgcacc

SEQ ID NO: 595639 - DNA, 476 bp, Homo sapiens; identical to SEQ ID NO: 541471
  misc_feature: HIJSMM301AN77X.13.4.A04.1.454.light.4.raw

SEQ ID NO: 595640 - DNA, 490 bp, Homo sapiens; identical to SEQ ID NO: 543909
  misc_feature: HIJSMM301C2TY9.14.55.E11.1.454.light.4.raw

SEQ ID NO: 595641 - DNA, 524 bp, Homo sapiens
  misc_feature: HIJSMM301EHJL8.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcggcgggggaccgaaggtgaccgtcctaagtcagcccaaggctgccccctcggtcactctgttcccaccctcctcacg

SEQ ID NO: 595642 - DNA, 504 bp, Homo sapiens
  misc_feature: HIJSMM301DFV2R.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggttacttttcgggttttcggtcggagggaccaagctgaccgtcctaggtcgagcccaacgggctcgtccccccg

SEQ ID NO: 595643 - DNA, 497 bp, Homo sapiens; identical to SEQ ID NO: 550536
  misc_feature: HIJSMM301D9HUX.40.34.D01.1.454.light.4.raw

SEQ ID NO: 595644 - DNA, 518 bp, Homo sapiens; identical to SEQ ID NO: 539372
  misc_feature: HIJSMM301AIIIU.7.86.H09.1.454.light.4.raw

SEQ ID NO: 595645 - DNA, 502 bp, Homo sapiens
  misc_feature: HIJSMM301D3T34.48.27.C05.1.454.light.4.raw
agtatacatacacgaccggtgctcgatttagacgcgatcgaagggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggactaagctgaccgtctaggtcagcccaaggctgccccctcggt

SEQ ID NO: 595646 - DNA, 494 bp, Homo sapiens; identical to SEQ ID NO: 535629
  misc_feature: HIJSMM301CPOMK.4.27.C05.1.454.light.4.raw

SEQ ID NO: 595647 - DNA, 512 bp, Homo sapiens
  misc_feature: HIJSMM301DPEQD.43.5.A05.1.454.light.4.raw
tgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggtttcggcggagggaccaagttgaccgtcctaggtcagcccaaggcctgccccctcggtcactctcgttcccaccctcctca

SEQ ID NO: 595648 - DNA, 493 bp, Homo sapiens; identical to SEQ ID NO: 535084
  misc_feature: HIJSMM301DKNM9.47.64.F09.1.454.light.4.raw

SEQ ID NO: 595649 - DNA, 502 bp, Homo sapiens
  misc_feature: HIJSMM301DOEYZ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccatgtcta

SEQ ID NO: 595650 - DNA, 506 bp, Homo sapiens; identical to SEQ ID NO: 534969
  misc_feature: HIJSMM301DFWXQ.18.37.D04.1.454.light.4.raw

SEQ ID NO: 595651 - DNA, 516 bp, Homo sapiens
  misc_feature: HIJSMM301CS9MG.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactcttcg

SEQ ID NO: 595652 - DNA, 489 bp, Homo sapiens; identical to SEQ ID NO: 535139
  misc_feature: HIJSMM301CB143.14.55.E11.1.454.light.4.raw

SEQ ID NO: 595653 - DNA, 495 bp, Homo sapiens; identical to SEQ ID NO: 538434
  misc_feature: HIJSMM301CITK4.51.81.H04.1.454.light.4.raw

SEQ ID NO: 595654 - DNA, 492 bp, Homo sapiens; identical to SEQ ID NO: 535126
  misc_feature: HIJSMM301AVBT7.18.11.A11.1.454.light.4.raw

SEQ ID NO: 595655 - DNA, 485 bp, Homo sapiens
  misc_feature: HIJSMM301DR9NR.3.1.A01.1.454.light.4.raw
agacgcactccacgaccggtgctcgatttagacgtctcatcaggggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgcccaaagctccttatctctgatgcctccaatttgcacagtcggggtcccaccaacgttcagcggcagtggatctgggacagagttcactctcaccatcagcagcctgcagcctgacgatgtggcaacttattactgccaacagtatgatagttattggacgttcggccaacgggaccaagaatagaaatacaaacgaactagtggctgcaccatcttcg

SEQ ID NO: 595656 - DNA, 507 bp, Homo sapiens
  misc_feature: HIJSMM301A6WUD.18.78.H01.1.454.light.4.raw
  modified_base (503)..(503): a, c, t, g, unknown or other
tacgagtatgcacgaccggtgctcgatttagtgtgagtagtttggggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccacngtca

SEQ ID NO: 595657 - DNA, 496 bp, Homo sapiens
  misc_feature: HIJSMM301DTY35.47.64.F09.1.454.light.4.raw
  modified_base (419)..(419): a, c, t, g, unknown or other
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttcnggcctccgctcactttcggcggagggaccagggtggagatcaaacgaactgtggctgcaccatctgtcttcattccc

SEQ ID NO: 595658 - DNA, 498 bp, Homo sapiens
  misc_feature: HIJSMM301D062L.43.37.D04.1.454.light.4.raw
tgtgagtagtcacgaccggtgctcgatttagtagcatactgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagccccg

SEQ ID NO: 595659 - DNA, 417 bp, Homo sapiens
  misc_feature: HIJSMM301A4004.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggcccaaccccactgtcactctgttcccaccctcctcgagtagtaca

SEQ ID NO: 595660 - DNA, 501 bp, Homo sapiens
  misc_feature: HIJSMM301BXZRU.4.39.D06.1.454.light.4.raw
agcactgtagcacgaccggtgctcgatttagtgacatctcgcagttctttggggggggtctcaggaggcagcactctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtctaggtcagcccaaggctgccccctc

SEQ ID NO: 595661 - DNA, 504 bp, Homo sapiens
  misc_feature: HIJSMM301BQRPI.43.15.B04.1.454.light.4.raw
tgtgagtagtcacgaccggtgctcgatttagacagtatatatccgcggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctcccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtggaattcaaccgaactgtggctgcaccatctgtcttcatcttcccg

SEQ ID NO: 595662 - DNA, 507 bp, Homo sapiens
  misc_feature: HIJSMM301B6VJ0.43.48.E04.1.454.light.4.raw
tgtgagtagtcacgaccggtgctcgatttagagagcgtcacagagagaaggggctgggcctcaggaagcagcatcgggggtgccgcagccatggcctggaccgctctccttctgagcctccttgctcactttacagagtctgtggcctcctacgagctgactcagccaccctcagtgtcagtggccctgggacaggcggccaggataacctgtgggggacacaatattgcagataagagtgtccactggtatcaccagaagcccggccaggcccctgtattggtcatctacagagacaccagccggcccgctgggatccctgagcgattctctgcctccaactcggggaacacggccaccctgaccatcagcagagcccaagtcggggatgagggtgactattactgtcaagtgtgggacaagagcactgtgattttcggcggaggggccaagttgaccgtttaggtcagcccaaggctgccccctcggtcactctgttcccaccct

SEQ ID NO: 595663 - DNA, 488 bp, Homo sapiens
  misc_feature: HIJSMM301B3EW8.21.65.F10.1.454.light.4.raw
  modified_base (385)..(385): a, c, t, g, unknown or other
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagnttttgaagttttattctgtctgcagtacaatcagtggcctcggacgttcggtcaagggaccaaggtggaaatcaaacgaactgtggctgcaccatctgtcttc

SEQ ID NO: 595664 - DNA, 494 bp, Homo sapiens; identical to SEQ ID NO: 534994
  misc_feature: HIJSMM301AQ924.27.78.H01.1.454.light.4.raw

SEQ ID NO: 595665 - DNA, 522 bp, Homo sapiens; identical to SEQ ID NO: 543470
  misc_feature: HIJSMM301BPXAK.5.27.C05.1.454.light.4.raw

SEQ ID NO: 595666 - DNA, 554 bp, Homo sapiens
  misc_feature: HIJSMM301CKH5A.15.78.H01.1.454.light.4.raw
tctacgtagccacgaccggtgctcgatttagtgtgagtagtttgggtttggggtacgatttgatgttacctgatgcttagaggcttttcctggaagcaggacatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatcttcccgccatctgagctacgtagac

SEQ ID NO: 595667 - DNA, 490 bp, Homo sapiens
  misc_feature: HIJSMM301BBI3M.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtctggggcggagttcactctcaccatcagcagcctgcagtctgaagattttgcagtttattactgtcagcactctaatgactggccctgtacacttttggcccggggaccaaggtggagatcaacgaactgtggctgcaccatctgtcttcat

SEQ ID NO: 595668 - DNA, 486 bp, Homo sapiens; identical to SEQ ID NO: 535043
  misc_feature: HIJSMM301CYYVA.46.35.D02.1.454.light.4.raw

SEQ ID NO: 595669 - DNA, 490 bp, Homo sapiens; identical to SEQ ID NO: 551475
  misc_feature: HIJSMM301CHBZE.51.71.G05.1.454.light.4.raw

SEQ ID NO: 595670 - DNA, 469 bp, Homo sapiens
  misc_feature: HIJSMM301DV38B.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtacaaaagaatagcgctgccccgctcagtttcggcggagggaccaaggtggagataacg

SEQ ID NO: 595671 - DNA, 512 bp, Homo sapiens; identical to SEQ ID NO: 541300
  misc_feature: HIJSMM301ASRYJ.17.33.C11.1.454.light.4.raw

SEQ ID NO: 595672 - DNA, 499 bp, Homo sapiens
  misc_feature: HIJSMM301AD3UT.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccgaggggaccgaaggtggagatacaaacgaaactagtggctgcaccatctgtcttcatcttcccg

SEQ ID NO: 595673 - DNA, 490 bp, Homo sapiens
  misc_feature: HIJSMM301D1QDB.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtctaacaggctaacactttccccctcactttcggcggagggaccaaggtggagatcaagcgaactgtggctgcaccat

SEQ ID NO: 595674 - DNA, 493 bp, Homo sapiens
  misc_feature: HIJSMM301DAUPE.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggacccagggtggagatcaaacgaactgtggctgcaccatctgtcttcat

SEQ ID NO: 595675 - DNA, 489 bp, Homo sapiens; identical to SEQ ID NO: 565291
  misc_feature: HIJSMM301AK4MP.49.45.E01.1.454.light.4.raw

SEQ ID NO: 595676 - DNA, 485 bp, Homo sapiens; identical to SEQ ID NO: 582490
  misc_feature: HIJSMM301BT1AS.47.46.E02.1.454.light.4.raw

SEQ ID NO: 595677 - DNA, 480 bp, Homo sapiens; identical to SEQ ID NO: 568579
  misc_feature: HIJSMM301A0FFD.43.87.H10.1.454.light.4.raw

SEQ ID NO: 595678 - DNA, 497 bp, Homo sapiens
  misc_feature: HIJSMM301CYL26.22.14.B03.1.454.light.4.raw
acatacgcgtcacgaccggtgctcgatttagtgtgagtagtcccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 595679 - DNA, 443 bp, Homo sapiens
  misc_feature: HIJSMM301CAC4M.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccacctcctccactactatg

SEQ ID NO: 595680 - DNA, 483 bp, Homo sapiens
  misc_feature: HIJSMM301APK6S.49.53.E09.1.454.light.4.raw
agtcgagagacacgaccggtgctcgatttagagagagtgtgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccat

SEQ ID NO: 595681 - DNA, 507 bp, Homo sapiens; identical to SEQ ID NO: 550515
  misc_feature: HIJSMM301DCMCU.12.73.G07.1.454.light.4.raw

SEQ ID NO: 595682 - DNA, 445 bp, Homo sapiens
  misc_feature: HIJSMM301COSEN.5.9.A09.1.454.light.4.raw
atcagacacgcacgaccggtgctcgatttagcgagacgcgcagggtcctggacccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctgttcccgccctcctccgtgtctgat

SEQ ID NO: 595683 - DNA, 497 bp, Homo sapiens; identical to SEQ ID NO: 539058
  misc_feature: HIJSMM301DQRD5.12.87.H10.1.454.light.4.raw

SEQ ID NO: 595684 - DNA, 503 bp, Homo sapiens
  misc_feature: HIJSMM301BZ8SS.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggaggaccaagctgaccgtcctaggtcagcccaaggctgccccctcggtcta

SEQ ID NO: 595685 - DNA, 521 bp, Homo sapiens; identical to SEQ ID NO: 536990
  misc_feature: HIJSMM301BAHBE.27.23.C01.1.454.light.4.raw
  modified_base (517)..(517): a, c, t, g, unknown or other

SEQ ID NO: 595686 - DNA, 486 bp, Homo sapiens; identical to SEQ ID NO: 535385
  misc_feature: HIJSMM301C5BQ8.19.71.G05.1.454.light.4.raw

SEQ ID NO: 595687 - DNA, 494 bp, Homo sapiens; identical to SEQ ID NO: 535828
  misc_feature: HIJSMM301EKCAA.3.36.D03.1.454.light.4.raw

SEQ ID NO: 595688 - DNA, 497 bp, Homo sapiens; identical to SEQ ID NO: 536371
  misc_feature: HIJSMM301DYEIN.16.78.H01.1.454.light.4.raw

SEQ ID NO: 595689 - DNA, 478 bp, Homo sapiens
  misc_feature: HIJSMM301EHYY6.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggaggaccgaagctgaccgtcctaagtcagcccaa

SEQ ID NO: 595690 - DNA, 483 bp, Homo sapiens
  misc_feature: HIJSMM301DIJA0.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccacttcggccctgggaccaaagtggatatcaaacgaactgtggctgcacatctgtt

SEQ ID NO: 595691 - DNA, 485 bp, Homo sapiens; identical to SEQ ID NO: 536630
  misc_feature: HIJSMM301EGRXN.13.56.F01.1.454.light.4.raw

SEQ ID NO: 595692 - DNA, 499 bp, Homo sapiens
  misc_feature: HIJSMM301CP74X.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgtacttttggccgagggggccaagctggagatcagacgaactgtgctgcaccatctgtcttctatcttccccg

SEQ ID NO: 595693 - DNA, 483 bp, Homo sapiens
  misc_feature: HIJSMM301CA1TG.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctgggcacagatttcactctcaccatcagcagcctgcagcctgaggattttgcaacttattactgtctacaagattacacttaccctgggacgttcggccaagggaccaaggtggaaatcaaacgaactagtggctgcaccta

SEQ ID NO: 595694 - DNA, 508 bp, Homo sapiens; identical to SEQ ID NO: 539240
  misc_feature: HIJSMM301BBLXK.40.16.B05.1.454.light.4.raw

SEQ ID NO: 595695 - DNA, 487 bp, Homo sapiens
  misc_feature: HIJSMM301CQUGI.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggcctgggactaagggtgagatcagacgaactggtggcgtgacaccatctgttctcta

SEQ ID NO: 595696 - DNA, 508 bp, Homo sapiens
  misc_feature: HIJSMM301CK32Z.5.59.F04.1.454.light.4.raw
atcagacacgcacgaccggtgctcgatttagtacacacacttagggattggggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtattttgctagtgtattactgtcagcagtatggtagctcacggacgtcggtccgaacgggacgaacggtaggaatacgaaacgaacgtagtggcgtgccgaccactctgtcttc

SEQ ID NO: 595697 - DNA, 492 bp, Homo sapiens; identical to SEQ ID NO: 571741
  misc_feature: HIJSMM301BQNC0.15.3.A03.1.454.light.4.raw

SEQ ID NO: 595698 - DNA, 486 bp, Homo sapiens
  misc_feature: HIJSMM301DZIZV.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccaacagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctccgctacgtaga

SEQ ID NO: 595699 - DNA, 517 bp, Homo sapiens
  misc_feature: HIJSMM301BE4UX.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctcgccccctcggtccactctgttcccaccctcct

SEQ ID NO: 595700 - DNA, 494 bp, Homo sapiens
  misc_feature: HIJSMM301B83I6.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacacgtggatatcaggcgaactgtggctgcaccatctgtctt

SEQ ID NO: 595701 - DNA, 454 bp, Homo sapiens; identical to SEQ ID NO: 534964
  misc_feature: HIJSMM301DNGBH.19.86.H09.1.454.light.4.raw

SEQ ID NO: 595702 - DNA, 482 bp, Homo sapiens; identical to SEQ ID NO: 541033
  misc_feature: HIJSMM301C5SUK.4.27.C05.1.454.light.4.raw

SEQ ID NO: 595703 - DNA, 488 bp, Homo sapiens
  misc_feature: HIJSMM301DOCOT.15.28.C06.1.454.light.4.raw
tctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccaggtcagagtattactaaatggttggcctggtttcagcaggaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 595704 - DNA, 477 bp, Homo sapiens
  misc_feature: HIJSMM301B0W2B.51.61.F06.1.454.light.4.raw
cgatcgtatacacgaccggtgctcgatttagctacgctctaagggaaagggggctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggccaagggaccaaggtggaaatacaaacgaactagtggctgcaccatctgtcttcatcttcccgccatctgatcgtagcact

SEQ ID NO: 595705 - DNA, 496 bp, Homo sapiens
  misc_feature: HIJSMM301E29CI.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 595706 - DNA, 515 bp, Homo sapiens
  misc_feature: HIJSMM301BN7L8.43.19.B08.1.454.light.4.raw
tgtgagtagtcacgaccggtgctcgatttagtgagtcagtaagggggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcggccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctc

SEQ ID NO: 595707 - DNA, 486 bp, Homo sapiens; identical to SEQ ID NO: 535043
  misc_feature: HIJSMM301AG83C.46.35.D02.1.454.light.4.raw

SEQ ID NO: 595708 - DNA, 482 bp, Homo sapiens; identical to SEQ ID NO: 593146
  misc_feature: HIJSMM301DQDTO.41.33.C11.1.454.light.4.raw

SEQ ID NO: 595709 - DNA, 493 bp, Homo sapiens
  misc_feature: HIJSMM301ELVCK.41.23.C01.1.454.light.4.raw
tctatactatcacgaccggtgctcgatttagtacacgtgattagggattgggggggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctcggt

SEQ ID NO: 595710 - DNA, 517 bp, Homo sapiens
  misc_feature: HIJSMM301E0MY5.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactacttttatgttcgggactgggaccaaggtcaccgtcctaggtcagcccaacggccaaccccactcgtcactcttccg

SEQ ID NO: 595711 - DNA, 522 bp, Homo sapiens
  misc_feature: HIJSMM301D2JVF.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcggggggaccaagggtgaccgtcctaagtcagcccaaggctgccccctcggtcactctgttcccgccct

SEQ ID NO: 595712 - DNA, 481 bp, Homo sapiens
  misc_feature: HIJSMM301AZP53.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaacggtggagatcaaacgaaactgtggctgcacc

SEQ ID NO: 595713 - DNA, 467 bp, Homo sapiens
  misc_feature: HIJSMM301C7765.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcccagtggcagtggatctgggacagatttcactctcaccatcagcagcctgcagcctgaagatgttgcaacttattactgtcaaaagaatagcgctgccccgctcagtttcggcggagggaccaaggtggagata

SEQ ID NO: 595714 - DNA, 473 bp, Homo sapiens
  misc_feature: HIJSMM301AIB9Q.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcggggggaccgaaggtggaggatcaacgaa

SEQ ID NO: 595715 - DNA, 492 bp, Homo sapiens
  misc_feature: HIJSMM301A12MD.48.28.C06.1.454.light.4.raw
agtatacatacacgaccggtgctcgatttagagctcacgtattgggtttggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaaggctgacagtcctaggtcagcccaaggctgccccccg

SEQ ID NO: 595716 - DNA, 489 bp, Homo sapiens
  misc_feature: HIJSMM301BO8IN.4.2.A02.1.454.light.4.raw
agcactgtagcacgaccggtgctcgatttagactcatctacaggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagtattttgcaacttactactgtcaacagagttacgactacccctccgctcactttcggcggagggaccgaaggtggagatacaaacgaactgtggctgcaccatctgtcttcta

SEQ ID NO: 595717 - DNA, 504 bp, Homo sapiens; identical to SEQ ID NO: 535077
  misc_feature: HIJSMM301D9ZN2.8.28.C06.1.454.light.4.raw

SEQ ID NO: 595718 - DNA, 490 bp, Homo sapiens
  misc_feature: HIJSMM301CRTFA.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtctaggtcagcccaaggccaacccactgtcact

SEQ ID NO: 595719 - DNA, 496 bp, Homo sapiens
  misc_feature: HIJSMM301DB5BH.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggaggaccaggctgaccgtcctgagtcagcccaaggctg

SEQ ID NO: 595720 - DNA, 503 bp, Homo sapiens; identical to SEQ ID NO: 535044
  misc_feature: HIJSMM301CORQS.19.78.H01.1.454.light.4.raw

SEQ ID NO: 595721 - DNA, 525 bp, Homo sapiens
  misc_feature: HIJSMM301C5OHI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccttcc

SEQ ID NO: 595722 - DNA, 495 bp, Homo sapiens
  misc_feature: HIJSMM301CL30L.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtgcctcgaacgttcggcccagggacccacagtgggatatcaggcgaactgtggctgcaccatctgtcttc

SEQ ID NO: 595723 - DNA, 520 bp, Homo sapiens; identical to SEQ ID NO: 579367
  misc_feature: HIJSMM301BQM43.27.23.C01.1.454.light.4.raw

SEQ ID NO: 595724 - DNA, 467 bp, Homo sapiens
  misc_feature: HIJSMM301DMEIQ.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagtcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctcgttcccaccctcctcctagtctacg

SEQ ID NO: 595725 - DNA, 508 bp, Homo sapiens
  misc_feature: HIJSMM301BKMEH.49.31.C09.1.454.light.4.raw
agtcgagagacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaatttttaatgtggtattcggcggagggaccaagctgaccgtcctaggtcagcccaaggctgccccctggtcactctgttcccta

SEQ ID NO: 595726 - DNA, 486 bp, Homo sapiens
  misc_feature: HIJSMM301EUKYM.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaaggaccaagctggagatcaaagaactgtggctgcacc

SEQ ID NO: 595727 - DNA, 512 bp, Homo sapiens
  misc_feature: HIJSMM301A60JQ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacgtttcggcccgtcgggaccgaaagtggatatacaaacgaactagtggctgcaccatctgtctt

SEQ ID NO: 595728 - DNA, 491 bp, Homo sapiens; identical to SEQ ID NO: 536549
  misc_feature: HIJSMM301C0WHA.47.55.E11.1.454.light.4.raw

SEQ ID NO: 595729 - DNA, 512 bp, Homo sapiens
  misc_feature: HIJSMM301B6NYO.18.59.F04.1.454.light.4.raw
  modified_base (436)..(437): a, c, t, g, unknown or other
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacnncactactcatcttcgtacgtagtcggacgtacgtccgaccgtcgtacgtacgaccaccgacgacccaaccctacg

SEQ ID NO: 595730 - DNA, 488 bp, Homo sapiens
  misc_feature: HIJSMM301BAC51.5.39.D06.1.454.light.4.raw
atcagacacgcacgaccggtgctcgatttagtgacatctcgcagttctttggggaggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggtccgaggggaccgaaggtacgaaatagagacgaactagtggctgcacc

SEQ ID NO: 595731 - DNA, 486 bp, Homo sapiens
  misc_feature: HIJSMM301DIKBR.47.38.D05.1.454.light.4.raw
agctcacgtacacgaccggtgctcgatttagtatctgatagttgggtttggggtgatcaggactcatcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcggggcctccgggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 595732 - DNA, 499 bp, Homo sapiens
  misc_feature: HIJSMM301CVUVD.40.34.D01.1.454.light.4.raw
tctagcgactcacgaccggtgctcgatttagatcgtctgtgttgggtttggggtggggtctcaggaggcagcactctcgggacgtctccaccatggcctgggctctgctcctcctcagcctcctcacttagggcacaggatcctgggctcactctaccctgactcagcctcgctcagtgtccgggtctcctggacagtcagtcaccatctcctgcactggaaccagcagtgatattggtgcttataactctgtctcctggtaccaacaacaccgggcaaaggtcccaaacttctgatttatgatgtcactaagcggccctcaggggtcgctgatcgcttctctggctccaagtctggcgacacggcctccctgaccatctctggctccagactgaggatgaggctacttattttgtctgctcttatgtcaggctagttcgctctcgaagtgttcggcggagggaccgagctgaccgtcctacgtcagccaaggctcccg

SEQ ID NO: 595733 - DNA, 490 bp, Homo sapiens; identical to SEQ ID NO: 543909
  misc_feature: HIJSMM301BIZ7H.14.55.E11.1.454.light.4.raw

SEQ ID NO: 595734 - DNA, 466 bp, Homo sapiens; identical to SEQ ID NO: 535366
  misc_feature: HIJSMM301CB2PZ.13.4.A04.1.454.light.4.raw

SEQ ID NO: 595735 - DNA, 489 bp, Homo sapiens
  misc_feature: HIJSMM301BAW3V.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactc

SEQ ID NO: 595736 - DNA, 521 bp, Homo sapiens
  misc_feature: HIJSMM301EGWNX.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagactgaccgtcctaggtcagcccaaggctgccccctcggtcactctgttcccaccct

SEQ ID NO: 595737 - DNA, 506 bp, Homo sapiens; identical to SEQ ID NO: 536045
  misc_feature: HIJSMM301BQNLD.9.12.B01.1.454.light.4.raw

SEQ ID NO: 595738 - DNA, 513 bp, Homo sapiens; identical to SEQ ID NO: 554427
  misc_feature: HIJSMM301ALZ6U.17.33.C11.1.454.light.4.raw

SEQ ID NO: 595739 - DNA, 505 bp, Homo sapiens; identical to SEQ ID NO: 545964
  misc_feature: HIJSMM301AVBUL.10.12.B01.1.454.light.4.raw

SEQ ID NO: 595740 - DNA, 500 bp, Homo sapiens
  misc_feature: HIJSMM301CYJUA.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtccaggtcagcccaaggcagccccctggtca

SEQ ID NO: 595741 - DNA, 506 bp, Homo sapiens
  misc_feature: HIJSMM301CQUNF.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcgggcggagggaccaagctgaccgtcctaagtcagcccaaggctgccccctcggtcactctcgttcccacct

SEQ ID NO: 595742 - DNA, 508 bp, Homo sapiens
  misc_feature: HIJSMM301CRCP7.48.27.C05.1.454.light.4.raw
agtatacatacacgaccggtgctcgatttagacgcgatcgaagggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggaggaccaagctgaccgtctgggtcagcccaaggctgcccctcggtcactctgttcccta

SEQ ID NO: 595743 - DNA, 517 bp, Homo sapiens
  misc_feature: HIJSMM301AK92X.43.81.H04.1.454.light.4.raw
tgtgagtagtcacgaccggtgctcgatttagtagtgtagattcgcgggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctcgccccctcggtcactctgttcccaccctcctcacta

SEQ ID NO: 595744 - DNA, 493 bp, Homo sapiens
  misc_feature: HIJSMM301DXQZT.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagtagggccactggtaccccagccaggttcagtggcagtgggtctgggacagagttcactctcaccatcagcagcctgcagtctgaagattttgcagtttattactgtcagcagtataattactggcctcggacgttcggtccagggaccaaggtggaagtcaacgaactgtggctgcaccatctgtcttcta

SEQ ID NO: 595745 - DNA, 511 bp, Homo sapiens; identical to SEQ ID NO: 537464
  misc_feature: HIJSMM301AXBPG.7.34.D01.1.454.light.4.raw

SEQ ID NO: 595746 - DNA, 507 bp, Homo sapiens
  misc_feature: HIJSMM301CMPJP.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaaggctgaccgtcctaggtcacg

SEQ ID NO: 595747 - DNA, 502 bp, Homo sapiens; identical to SEQ ID NO: 536253
  misc_feature: HIJSMM301DP8JW.21.22.B11.1.454.light.4.raw

SEQ ID NO: 595748 - DNA, 454 bp, Homo sapiens; identical to SEQ ID NO: 534964
  misc_feature: HIJSMM301DUJYY.19.86.H09.1.454.light.4.raw

SEQ ID NO: 595749 - DNA, 493 bp, Homo sapiens; identical to SEQ ID NO: 537422
  misc_feature: HIJSMM301B16MQ.9.34.D01.1.454.light.4.raw

SEQ ID NO: 595750 - DNA, 472 bp, Homo sapiens; identical to SEQ ID NO: 536302
  misc_feature: HIJSMM301A8687.18.76.G10.1.454.light.4.raw

SEQ ID NO: 595751 - DNA, 510 bp, Homo sapiens
  misc_feature: HIJSMM301A5WWN.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaccccactgtcactctcg

SEQ ID NO: 595752 - DNA, 444 bp, Homo sapiens
  misc_feature: HIJSMM301APMD2.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcacaccctcctcgacacgcgag

SEQ ID NO: 595753 - DNA, 494 bp, Homo sapiens; identical to SEQ ID NO: 535680
  misc_feature: HIJSMM301AXF1Y.16.78.H01.1.454.light.4.raw

SEQ ID NO: 595754 - DNA, 495 bp, Homo sapiens; identical to SEQ ID NO: 563808
  misc_feature: HIJSMM301C0G7H.40.57.F02.1.454.light.4.raw

SEQ ID NO: 595755 - DNA, 508 bp, Homo sapiens; identical to SEQ ID NO: 536388
  misc_feature: HIJSMM301BB5KL.11.57.F02.1.454.light.4.raw

SEQ ID NO: 595756 - DNA, 503 bp, Homo sapiens
  misc_feature: HIJSMM301BZTBN.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaacgaactgtggctgcaccatctgtcttcatcttcccgcc

SEQ ID NO: 595757 - DNA, 523 bp, Homo sapiens
  misc_feature: HIJSMM301BH9LY.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtaggcgaatcaaacccgaactagtggctgcaccatctgtcttcatcttccccg

SEQ ID NO: 595758 - DNA, 519 bp, Homo sapiens
  misc_feature: HIJSMM301EBOC9.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctactgctgctgggtctggccatggtcgcccatggcctgctgcgcccaatggttgcaccgcaaagcggggacccagaccctggagcctcagttggaagcagccgatccagcctgcggagcctggtgggcaggtcagcccaaggcctgccccctcggtcactctgttcccgccctcctccacg

SEQ ID NO: 595759 - DNA, 507 bp, Homo sapiens
  misc_feature: HIJSMM301BCRL7.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttagccttgtctcctggtaccaagtgcacccaggcaaagcccccaaactcatgatttatgagggcactaagcggccctcaggggtttcttatcgcttctctggctccaagtctggcaacacggcctccctgaccatctctgggctccaggctgaggacgaggctgattattattgccgctcatatgcaggtagttacacttatgttcttcggaattgggacgacggtcaccgtcctaggtcagcccaaggcccaaccccactgtcta

SEQ ID NO: 595760 - DNA, 521 bp, Homo sapiens; identical to SEQ ID NO: 536990
  misc_feature: HIJSMM301EDDAN.27.23.C01.1.454.light.4.raw
  modified_base (517)..(517): a, c, t, g, unknown or other

SEQ ID NO: 595761 - DNA, 512 bp, Homo sapiens
  misc_feature: HIJSMM301AYKS7.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccaaggaccagtggcatcaaccgaactgtggctgcacatctgtcttcatcttccccg

SEQ ID NO: 595762 - DNA, 494 bp, Homo sapiens; identical to SEQ ID NO: 534994
  misc_feature: HIJSMM301CQAUG.27.78.H01.1.454.light.4.raw

SEQ ID NO: 595763 - DNA, 511 bp, Homo sapiens
  misc_feature: HIJSMM301B4Q1H.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctcgccccctcggt

SEQ ID NO: 595764 - DNA, 463 bp, Homo sapiens; identical to SEQ ID NO: 535062
  misc_feature: HIJSMM301CLNCI.11.73.G07.1.454.light.4.raw

SEQ ID NO: 595765 - DNA, 509 bp, Homo sapiens
  misc_feature: HIJSMM301BMW3A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaacggtggaaagtacaaacgaactagtggctgcaccatctgtcttctactcttccccg

SEQ ID NO: 595766 - DNA, 499 bp, Homo sapiens
  misc_feature: HIJSMM301EDUQA.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccca

SEQ ID NO: 595767 - DNA, 486 bp, Homo sapiens; identical to SEQ ID NO: 535385
  misc_feature: HIJSMM301EYVGM.19.71.G05.1.454.light.4.raw

SEQ ID NO: 595768 - DNA, 505 bp, Homo sapiens
  misc_feature: HIJSMM301D2CLP.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccgtccctcctccgctacgtacgaa

SEQ ID NO: 595769 - DNA, 487 bp, Homo sapiens; identical to SEQ ID NO: 536206
  misc_feature: HIJSMM301CZO7R.47.38.D05.1.454.light.4.raw

SEQ ID NO: 595770 - DNA, 507 bp, Homo sapiens
  misc_feature: HIJSMM301AEB11.40.47.E03.1.454.light.4.raw
tctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtc

SEQ ID NO: 595771 - DNA, 489 bp, Homo sapiens
  misc_feature: HIJSMM301B2YNI.52.85.H08.1.454.light.4.raw
cgcagtacgacacgaccggtgctcgatttagtatcactcagtcgcgggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 595772 - DNA, 492 bp, Homo sapiens
  misc_feature: HIJSMM301B2CXV.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagactccactctcaccatcagcagcctagagcctgaagacttttggactttattactgtcagcagcgtgagttctggcctccgctcactttcggcggagggaccagggtggagatcaacgaactgtggctgcaccatctgtcttcat

SEQ ID NO: 595773 - DNA, 483 bp, Homo sapiens
  misc_feature: HIJSMM301CJRB0.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcgcggagggaccgaaggtggagatcaacgaa

SEQ ID NO: 595774 - DNA, 521 bp, Homo sapiens
  misc_feature: HIJSMM301EIH0I.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 595775 - DNA, 486 bp, Homo sapiens; identical to SEQ ID NO: 535458
  misc_feature: HIJSMM301BATCC.7.75.G09.1.454.light.4.raw

SEQ ID NO: 595776 - DNA, 520 bp, Homo sapiens; identical to SEQ ID NO: 544512
  misc_feature: HIJSMM301A0VYO.7.86.H09.1.454.light.4.raw

SEQ ID NO: 595777 - DNA, 489 bp, Homo sapiens
  misc_feature: HIJSMM301BX2L0.19.57.F02.1.454.light.4.raw
  modified_base (479)..(479): a, c, t, g, unknown or other
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtgggtcccctcaaggttcagcggcagtggatctgggacagatttcactctcgccatcagcagcctgcagactgaagattttgcaacttattttgtcaacaggctaacactttcccctccacttcgtcggaggacgaacgtaggagatcaagacgaacgcgtggngtcgcacact

SEQ ID NO: 595778 - DNA, 511 bp, Homo sapiens
  misc_feature: HIJSMM301CHJUW.52.53.E09.1.454.light.4.raw
cgcagtacgacacgaccggtgctcgatttagagagagtgtgttgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtggaaatcaaacgaactgtggctgcaccatctgtcttcta

SEQ ID NO: 595779 - DNA, 488 bp, Homo sapiens; identical to SEQ ID NO: 555249
  misc_feature: HIJSMM301APUVR.17.34.D01.1.454.light.4.raw

SEQ ID NO: 595780 - DNA, 491 bp, Homo sapiens
  misc_feature: HIJSMM301DLQ9L.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggacagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctcttcggaactgggaccacggtcaccgtctaggtcagcccaaggccaaccc

SEQ ID NO: 595781 - DNA, 498 bp, Homo sapiens
  misc_feature: HIJSMM301DZ653.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctacaagtgatcaccttcggccaagggacacggactggaagattaaacgaactgtggctgcaccatcctgtctt

SEQ ID NO: 595782 - DNA, 482 bp, Homo sapiens
  misc_feature: HIJSMM301B0WRR.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtgaaatcaaacgaactgtggctgcaccatctgtctt

SEQ ID NO: 595783 - DNA, 503 bp, Homo sapiens; identical to SEQ ID NO: 547049
  misc_feature: HIJSMM301AV3A1.18.59.F04.1.454.light.4.raw

SEQ ID NO: 595784 - DNA, 518 bp, Homo sapiens; identical to SEQ ID NO: 554776
  misc_feature: HIJSMM301D98S8.43.81.H04.1.454.light.4.raw

SEQ ID NO: 595785 - DNA, 506 bp, Homo sapiens; identical to SEQ ID NO: 545735
  misc_feature: HIJSMM301AH2QI.8.71.G05.1.454.light.4.raw

SEQ ID NO: 595786 - DNA, 523 bp, Homo sapiens
  misc_feature: HIJSMM301CWMMM.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccactcgtcactctcgttccccgccctccctccgt

SEQ ID NO: 595787 - DNA, 495 bp, Homo sapiens; identical to SEQ ID NO: 571222
  misc_feature: HIJSMM301D5UJM.16.6.A06.1.454.light.4.raw

SEQ ID NO: 595788 - DNA, 488 bp, Homo sapiens
  misc_feature: HIJSMM301DOX4E.3.10.A10.1.454.light.4.raw
agacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccact

SEQ ID NO: 595789 - DNA, 495 bp, Homo sapiens; identical to SEQ ID NO: 535007
  misc_feature: HIJSMM301BZYY3.22.5.A05.1.454.light.4.raw

SEQ ID NO: 595790 - DNA, 506 bp, Homo sapiens
  misc_feature: HIJSMM301EETHV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtggaaatacaaacgaactgtggctgcaccatctgtcttcatcttccccg

SEQ ID NO: 595791 - DNA, 486 bp, Homo sapiens; identical to SEQ ID NO: 536329
  misc_feature: HIJSMM301BXGVR.21.4.A04.1.454.light.4.raw

SEQ ID NO: 595792 - DNA, 497 bp, Homo sapiens; identical to SEQ ID NO: 536371
  misc_feature: HIJSMM301EGYDF.16.78.H01.1.454.light.4.raw

SEQ ID NO: 595793 - DNA, 502 bp, Homo sapiens
  misc_feature: HIJSMM301CR6BM.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaaatgggaccaaggtcaccgtctaggtcagcccaaggccaaccccactgtca

SEQ ID NO: 595794 - DNA, 505 bp, Homo sapiens
  misc_feature: HIJSMM301DYOXO.48.29.C07.1.454.light.4.raw
agtatacatacacgaccggtgctcgatttagagtgctacgaagggaaaggggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatcaaacgaactgtggctgcacc

SEQ ID NO: 595795 - DNA, 513 bp, Homo sapiens
  misc_feature: HIJSMM301DPU62.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctcctcc

SEQ ID NO: 595796 - DNA, 512 bp, Homo sapiens
  misc_feature: HIJSMM301B13ZZ.49.57.F02.1.454.light.4.raw
agtcgagagacacgaccggtgctcgatttagctcgatatagttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttccccg

SEQ ID NO: 595797 - DNA, 494 bp, Homo sapiens
  misc_feature: HIJSMM301DSXV2.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctgtcttcatcttcccg

SEQ ID NO: 595798 - DNA, 495 bp, Homo sapiens
  misc_feature: HIJSMM301EAIB8.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggcctccaggctgaggacgaggggtgattattactgcagctcatatagaagtggcagcactctcgtattcggcggtgggaccaagctgaccgtctaggtcagcccaagg

SEQ ID NO: 595799 - DNA, 467 bp, Homo sapiens
  misc_feature: HIJSMM301AXOBA.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaacggtggagatcaaacgaa

SEQ ID NO: 595800 - DNA, 520 bp, Homo sapiens; identical to SEQ ID NO: 539176
  misc_feature: HIJSMM301B2UF9.27.23.C01.1.454.light.4.raw

SEQ ID NO: 595801 - DNA, 512 bp, Homo sapiens; identical to SEQ ID NO: 562621
  misc_feature: HIJSMM301D9L2A.7.34.D01.1.454.light.4.raw

SEQ ID NO: 595802 - DNA, 484 bp, Homo sapiens; identical to SEQ ID NO: 535240
  misc_feature: HIJSMM301CQ679.47.60.F05.1.454.light.4.raw

SEQ ID NO: 595803 - DNA, 489 bp, Homo sapiens; identical to SEQ ID NO: 549642
  misc_feature: HIJSMM301BROXS.52.70.G04.1.454.light.4.raw

SEQ ID NO: 595804 - DNA, 504 bp, Homo sapiens; identical to SEQ ID NO: 538521
  misc_feature: HIJSMM301ETCI1.9.12.B01.1.454.light.4.raw

SEQ ID NO: 595805 - DNA, 507 bp, Homo sapiens
  misc_feature: HIJSMM301AFEA5.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgcttctctggctccaagtctggcaacacggcctccctgaccatctctgggctccaggctgaggacgaggctgatttattactgcagctcatatacaagcaccagcactctctatgtcttcggaactgggaaccaaggtccaccgtcctaggtcagcccaaggcccaacccc

SEQ ID NO: 595806 - DNA, 480 bp, Homo sapiens
  misc_feature: HIJSMM301D6BGV.51.61.F06.1.454.light.4.raw
  modified_base (424)..(424): a, c, t, g, unknown or other
cgatcgtatacacgaccggtgctcgatttagctacgctctaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagagttacagtacccctnaagctcactttcggcggaggaccaaggtggagatcaaacgaactgtggctgcacca

SEQ ID NO: 595807 - DNA, 488 bp, Homo sapiens; identical to SEQ ID NO: 536985
  misc_feature: HIJSMM301AJIC1.43.33.C11.1.454.light.4.raw

SEQ ID NO: 595808 - DNA, 505 bp, Homo sapiens; identical to SEQ ID NO: 536254
  misc_feature: HIJSMM301D5RE2.7.71.G05.1.454.light.4.raw

SEQ ID NO: 595809 - DNA, 504 bp, Homo sapiens
  misc_feature: HIJSMM301CM9YW.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaaccccactgt

SEQ ID NO: 595810 - DNA, 486 bp, Homo sapiens; identical to SEQ ID NO: 535043
  misc_feature: HIJSMM301BD028.46.35.D02.1.454.light.4.raw

SEQ ID NO: 595811 - DNA, 486 bp, Homo sapiens; identical to SEQ ID NO: 543543
  misc_feature: HIJSMM301C1AEN.49.3.A03.1.454.light.4.raw

SEQ ID NO: 595812 - DNA, 486 bp, Homo sapiens; identical to SEQ ID NO: 536261
  misc_feature: HIJSMM301BSW1B.26.55.E11.1.454.light.4.raw

SEQ ID NO: 595813 - DNA, 487 bp, Homo sapiens
  misc_feature: HIJSMM301AOE7I.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggaggatcaaacgaacg

SEQ ID NO: 595814 - DNA, 485 bp, Homo sapiens; identical to SEQ ID NO: 543548
  misc_feature: HIJSMM301BPBOY.15.28.C06.1.454.light.4.raw

SEQ ID NO: 595815 - DNA, 493 bp, Homo sapiens; identical to SEQ ID NO: 536769
  misc_feature: HIJSMM301CD6EH.19.83.H06.1.454.light.4.raw

SEQ ID NO: 595816 - DNA, 484 bp, Homo sapiens; identical to SEQ ID NO: 535400
  misc_feature: HIJSMM301D2LGC.46.26.C04.1.454.light.4.raw

SEQ ID NO: 595817 - DNA, 475 bp, Homo sapiens; identical to SEQ ID NO: 537570
  misc_feature: HIJSMM301BS0N2.13.4.A04.1.454.light.4.raw

SEQ ID NO: 595818 - DNA, 513 bp, Homo sapiens
  misc_feature: HIJSMM301CCGMR.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcgggcgggggaccaagctgaccgtcctaggtcagcccaaggctgccccctcggtcactcttccg

SEQ ID NO: 595819 - DNA, 511 bp, Homo sapiens; identical to SEQ ID NO: 548439
  misc_feature: HIJSMM301DWEGT.16.46.E02.1.454.light.4.raw

SEQ ID NO: 595820 - DNA, 504 bp, Homo sapiens
  misc_feature: HIJSMM301EKHPW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccaaggtaggaaatcaaacgaactagtggctgcaccatctgtcttcactcttccccg

SEQ ID NO: 595821 - DNA, 463 bp, Homo sapiens
  misc_feature: HIJSMM301DPBT8.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctggtcactctgttcccgccctcctcctagtctacg

SEQ ID NO: 595822 - DNA, 469 bp, Homo sapiens
  misc_feature: HIJSMM301AN3KO.48.77.G11.1.454.light.4.raw
agtatacatacacgaccggtgctcgatttagctagtcactcaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaag

SEQ ID NO: 595823 - DNA, 495 bp, Homo sapiens
  misc_feature: HIJSMM301C2EKP.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggcctcggacgttcggccaagggaccgaaggtaggaagtcaaacgaactagtggctgcaccatctgtctt

SEQ ID NO: 595824 - DNA, 483 bp, Homo sapiens; identical to SEQ ID NO: 550496
  misc_feature: HIJSMM301C8X36.41.78.H01.1.454.light.4.raw

SEQ ID NO: 595825 - DNA, 494 bp, Homo sapiens; identical to SEQ ID NO: 553476
  misc_feature: HIJSMM301A8GQ6.16.53.E09.1.454.light.4.raw

SEQ ID NO: 595826 - DNA, 493 bp, Homo sapiens; identical to SEQ ID NO: 536769
  misc_feature: HIJSMM301BWQWC.19.83.H06.1.454.light.4.raw

SEQ ID NO: 595827 - DNA, 504 bp, Homo sapiens; identical to SEQ ID NO: 549053
  misc_feature: HIJSMM301EHVMA.4.71.G05.1.454.light.4.raw

SEQ ID NO: 595828 - DNA, 488 bp, Homo sapiens
  misc_feature: HIJSMM301A49WG.41.39.D06.1.454.light.4.raw
tctatactatcacgaccggtgctcgatttagtgacatctcgcagttctttggggagagaagagctgctcagttaggacccagagggaaccatggaaaccccagcgcagcttctcttcctcctgctactctggctcccagataccaccgaagaaattgtgttgacgcagtctccaggcaccctgtctttgtctccaggagaaagagccaccctctcctgtagggccagtcagattgttagcagcggctacttagcctggttccagcagagacctggccaggctcccaggctcctcatctatgaagcgtccatcaggcccactggcatcccagacagattcagtggcagtgggtctgggacagacttcactctcaccatcagcggactggagcctgaagattttgcagtctattactgtcagcagtatggtggctcacctccgtacacctttggccaggggaccaagctggagatcaaacgaactgtggc

SEQ ID NO: 595829 - DNA, 494 bp, Homo sapiens; identical to SEQ ID NO: 534994
  misc_feature: HIJSMM301DG9OZ.27.78.H01.1.454.light.4.raw

SEQ ID NO: 595830 - DNA, 502 bp, Homo sapiens; identical to SEQ ID NO: 584199
  misc_feature: HIJSMM301BNIWP.51.23.C01.1.454.light.4.raw

SEQ ID NO: 595831 - DNA, 376 bp, Homo sapiens
  misc_feature: HIJSMM301DWA7Z.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccaacagagaccaggacaacctcctaagttgctctttactgggcgtcttcccgggagtccggggtccctgaccgattcagtgccagcgggtctgggacagacttcactctcacca

SEQ ID NO: 595832 - DNA, 509 bp, Homo sapiens; identical to SEQ ID NO: 539359
  misc_feature: HIJSMM301CN5M2.47.85.H08.1.454.light.4.raw

SEQ ID NO: 595833 - DNA, 474 bp, Homo sapiens; identical to SEQ ID NO: 574375
  misc_feature: HIJSMM301BXHPQ.18.76.G10.1.454.light.4.raw

SEQ ID NO: 595834 - DNA, 455 bp, Homo sapiens
  misc_feature: HIJSMM301C428U.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccctctgtcactcctgttcccgcccctcctccctactaactcggta

SEQ ID NO: 595835 - DNA, 470 bp, Homo sapiens
  misc_feature: HIJSMM301D97RX.49.4.A04.1.454.light.4.raw
agtcgagagacacgaccggtgctcgatttagagtagtgatcaggggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaactgtggctgcacca

SEQ ID NO: 595836 - DNA, 495 bp, Homo sapiens; identical to SEQ ID NO: 535821
  misc_feature: HIJSMM301DKO72.3.31.C09.1.454.light.4.raw

SEQ ID NO: 595837 - DNA, 501 bp, Homo sapiens; identical to SEQ ID NO: 540528
  misc_feature: HIJSMM301AFE7H.11.31.C09.1.454.light.4.raw

SEQ ID NO: 595838 - DNA, 498 bp, Homo sapiens
  misc_feature: HIJSMM301E3Y10.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggtcggaggggaccaacggtggaggaatcgaaacgaaactagtggcgtgcaccaactctgtctttcatt

SEQ ID NO: 595839 - DNA, 500 bp, Homo sapiens; identical to SEQ ID NO: 546613
  misc_feature: HIJSMM301DH6A0.11.21.B10.1.454.light.4.raw

SEQ ID NO: 595840 - DNA, 497 bp, Homo sapiens
  misc_feature: HIJSMM301CB84C.52.26.C04.1.454.light.4.raw
cgcagtacgacacgaccggtgctcgatttagtctagcgactttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggcctcagggatccctgagcgattctctggctcctcctcagggacaacagtcacgttgatcatcagtggagtccgggcagaggacgaggctgactatactgtcaatcaacagacagtagtggtacttatgtgcagttcggcggagggaccaagctgaccgtcctaggtcagcccaaggctgcccctcggtcactc

SEQ ID NO: 595841 - DNA, 490 bp, Homo sapiens
  misc_feature: HIJSMM301DRV54.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtccaccgtcctaggtcagcccaaggcccaacccca

SEQ ID NO: 595842 - DNA, 506 bp, Homo sapiens
  misc_feature: HIJSMM301ENZS4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtaggaaagtacaaacgaactagtggcgtgcaccatctgtcttcatcttccccg

SEQ ID NO: 595843 - DNA, 495 bp, Homo sapiens; identical to SEQ ID NO: 537415
  misc_feature: HIJSMM301B2KHM.4.27.C05.1.454.light.4.raw

SEQ ID NO: 595844 - DNA, 385 bp, Homo sapiens; identical to SEQ ID NO: 580402
  misc_feature: HIJSMM301BYH5M.48.37.D04.1.454.light.4.raw

SEQ ID NO: 595845 - DNA, 485 bp, Homo sapiens; identical to SEQ ID NO: 552583
  misc_feature: HIJSMM301AV8PI.40.83.H06.1.454.light.4.raw

SEQ ID NO: 595846 - DNA, 495 bp, Homo sapiens; identical to SEQ ID NO: 560927
  misc_feature: HIJSMM301APEW8.16.78.H01.1.454.light.4.raw

SEQ ID NO: 595847 - DNA, 497 bp, Homo sapiens
  misc_feature: HIJSMM301A61GZ.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtctaggtcagcccaaggctgccccccg

SEQ ID NO: 595848 - DNA, 501 bp, Homo sapiens; identical to SEQ ID NO: 536867
  misc_feature: HIJSMM301CXZH6.5.86.H09.1.454.light.4.raw

SEQ ID NO: 595849 - DNA, 514 bp, Homo sapiens
  misc_feature: HIJSMM301DWFN7.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgcctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 595850 - DNA, 514 bp, Homo sapiens
  misc_feature: HIJSMM301CH5PM.48.55.E11.1.454.light.4.raw
agtatacatacacgaccggtgctcgatttagcactcgcacgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgaccggttctctggctccaagtctggcacctcagcctccctggccatcactgggctccagactgaggatgaggctgattattactgccagtcctatgacagcaacctgagcggttgggtgttcggcggagggaccagggtgaccgtcctaagtcagcccaaggctgccccctggtcactctcg

SEQ ID NO: 595851 - DNA, 494 bp, Homo sapiens
  misc_feature: HIJSMM301AJO10.43.83.H06.1.454.light.4.raw
tgtgagtagtcacgaccggtgctcgatttagatcacgtgcgtcgcggggagagctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcagtggccatgggtctgggacggagttcactctcaccatcagccgactggagcctgaagattttgcagtatattactgtcaacaatatggtagttctcctctcactttcggcggagggaccaaggtggaagtacaacgaactgtggctgcaccatctgtcttcatt

SEQ ID NO: 595852 - DNA, 487 bp, Homo sapiens
  misc_feature: HIJSMM301AG4V7.46.26.C04.1.454.light.4.raw
actagcagtacacgaccggtgctcgatttagtctagcgactttgggtttggggtggtcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaacgaactgt

SEQ ID NO: 595853 - DNA, 492 bp, Homo sapiens
  misc_feature: HIJSMM301A0ZHM.51.28.C06.1.454.light.4.raw
cgatcgtatacacgaccggtgctcgatttagagctcacgtattgggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctcggtcact

SEQ ID NO: 595854 - DNA, 497 bp, Homo sapiens; identical to SEQ ID NO: 535286
  misc_feature: HIJSMM301DAWRO.18.59.F04.1.454.light.4.raw

SEQ ID NO: 595855 - DNA, 474 bp, Homo sapiens
  misc_feature: HIJSMM301B7GHN.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatacaaacgaactagtgg

SEQ ID NO: 595856 - DNA, 477 bp, Homo sapiens; identical to SEQ ID NO: 586043
  misc_feature: HIJSMM301DAP1D.7.81.H04.1.454.light.4.raw

SEQ ID NO: 595857 - DNA, 486 bp, Homo sapiens; identical to SEQ ID NO: 535043
  misc_feature: HIJSMM301D1CVZ.46.35.D02.1.454.light.4.raw

SEQ ID NO: 595858 - DNA, 512 bp, Homo sapiens
  misc_feature: HIJSMM301B2V0S.52.57.F02.1.454.light.4.raw
cgcagtacgacacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggtttcgcggagggaccaaggtgaccgtcctacgtcagcccaaggctgccccctggtcactc

SEQ ID NO: 595859 - DNA, 484 bp, Homo sapiens
  misc_feature: HIJSMM301EKDM4.46.26.C04.1.454.light.4.raw
actagcagtacacgaccggtgctcgatttagtctagcgactttgggtttggggcgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 595860 - DNA, 491 bp, Homo sapiens
  misc_feature: HIJSMM301CQ2EY.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaaggaccgaaggtggaagtcaaacgaactgtggctgcaccatctgtctt

SEQ ID NO: 595861 - DNA, 490 bp, Homo sapiens
  misc_feature: HIJSMM301BCF99.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacggaactgtggctgcaccatctgtcttcta

SEQ ID NO: 595862 - DNA, 486 bp, Homo sapiens; identical to SEQ ID NO: 535043
  misc_feature: HIJSMM301CQ6P4.46.35.D02.1.454.light.4.raw

SEQ ID NO: 595863 - DNA, 488 bp, Homo sapiens; identical to SEQ ID NO: 535081
  misc_feature: HIJSMM301CUMQJ.26.23.C01.1.454.light.4.raw

SEQ ID NO: 595864 - DNA, 494 bp, Homo sapiens; identical to SEQ ID NO: 541035
  misc_feature: HIJSMM301C0P4M.26.12.B01.1.454.light.4.raw

SEQ ID NO: 595865 - DNA, 501 bp, Homo sapiens; identical to SEQ ID NO: 535746
  misc_feature: HIJSMM301BLH98.18.11.A11.1.454.light.4.raw

SEQ ID NO: 595866 - DNA, 456 bp, Homo sapiens
  misc_feature: HIJSMM301D45MV.48.81.H04.1.454.light.4.raw
agtatacatacacgaccggtgctcgatttagtagtgtagattcgcggggaccctcagactgagccaacggccttttctggcctgatcacctgggcatgggctgctgagagcagaaaggggaggcagattgtctctgcagctgcaagcccagcacccgccccagctgctttgcatgtccctcccagccgccctgcagtccagagcccatatcaatgcctgggtcagagctctggagaagagctgctcagttaggacccagagggaaccatggaaaccccagcgcagcttctcttcctcctgctactctggctcccagatactaccggagaagttcttttctgtcagcagtatggtggctcacccgcgtacagttttggccaggggaccaagctggagatcaagcgaactgtggctgcaccatctgtcttcatcttcccgccatctgatatgtatact

SEQ ID NO: 595867 - DNA, 508 bp, Homo sapiens
  misc_feature: HIJSMM301DSQIH.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtctaggtcagcccaaggctgccccctcggtcactctgtt

SEQ ID NO: 595868 - DNA, 496 bp, Homo sapiens; identical to SEQ ID NO: 535109
  misc_feature: HIJSMM301EIW7O.16.78.H01.1.454.light.4.raw

SEQ ID NO: 595869 - DNA, 490 bp, Homo sapiens
  misc_feature: HIJSMM301C352A.53.35.D02.1.454.light.4.raw
cgcgtatacacacgaccggtgctcgatttagcacacgatagttgggtttgggggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagtccactctgaccatcagcgggacccaggctatggatgaggctgactattattgtcaggcgtgggacagcaacctgattgggtgttcggcggagggaccaaaactgaccgtcctaggtcagcccaaggctgccccctc

SEQ ID NO: 595870 - DNA, 493 bp, Homo sapiens; identical to SEQ ID NO: 561962
  misc_feature: HIJSMM301BRFK1.41.2.A02.1.454.light.4.raw

SEQ ID NO: 595871 - DNA, 480 bp, Homo sapiens; identical to SEQ ID NO: 535291
  misc_feature: HIJSMM301CY9WT.22.59.F04.1.454.light.4.raw

SEQ ID NO: 595872 - DNA, 495 bp, Homo sapiens
  misc_feature: HIJSMM301EXV0Q.52.73.G07.1.454.light.4.raw
cgcagtacgacacgaccggtgctcgatttagctctacgctcagggcacgaccggtgctcgatttagagagagtgtgttgggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctcaacctgaagattttgcaatttactactgtcaacagagtgacaatacccctcagactttcggccctcgggaccgacgagtggagtata

SEQ ID NO: 595873 - DNA, 494 bp, Homo sapiens
  misc_feature: HIJSMM301EFS6H.48.27.C05.1.454.light.4.raw
agtatacatacacgaccggtgctcgatttagacgcgatcgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccat

SEQ ID NO: 595874 - DNA, 520 bp, Homo sapiens
  misc_feature: HIJSMM301B1L7Z.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 595875 - DNA, 469 bp, Homo sapiens; identical to SEQ ID NO: 536091
  misc_feature: HIJSMM301BXDMO.3.82.H05.1.454.light.4.raw

SEQ ID NO: 595876 - DNA, 488 bp, Homo sapiens
  misc_feature: HIJSMM301D1YDO.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggatatcagacgaactgtgg

SEQ ID NO: 595877 - DNA, 506 bp, Homo sapiens
  misc_feature: HIJSMM301AKO1G.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacaggttttctcgggcgttcggccaagggaccgaaggtaggaaatcaaacgaactagtggctgcaccatctgtcttcatcttccccg

SEQ ID NO: 595878 - DNA, 508 bp, Homo sapiens; identical to SEQ ID NO: 540739
  misc_feature: HIJSMM301B921U.14.7.A07.1.454.light.4.raw

SEQ ID NO: 595879 - DNA, 496 bp, Homo sapiens; identical to SEQ ID NO: 535109
  misc_feature: HIJSMM301CPG12.16.78.H01.1.454.light.4.raw

SEQ ID NO: 595880 - DNA, 512 bp, Homo sapiens; identical to SEQ ID NO: 557140
  misc_feature: HIJSMM301AR48N.48.34.D01.1.454.light.4.raw

SEQ ID NO: 595881 - DNA, 514 bp, Homo sapiens; identical to SEQ ID NO: 544242
  misc_feature: HIJSMM301E1EIP.43.23.C01.1.454.light.4.raw

SEQ ID NO: 595882 - DNA, 515 bp, Homo sapiens
  misc_feature: HIJSMM301AN2Z0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaacgggaccgaacgggtaggaaagtacaaacgaaactagtggcgtgcaccatctgtcttctatcttccccg

SEQ ID NO: 595883 - DNA, 522 bp, Homo sapiens; identical to SEQ ID NO: 538091
  misc_feature: HIJSMM301ENOQY.27.23.C01.1.454.light.4.raw

SEQ ID NO: 595884 - DNA, 509 bp, Homo sapiens; identical to SEQ ID NO: 570701
  misc_feature: HIJSMM301EYOF5.8.42.D09.1.454.light.4.raw

SEQ ID NO: 595885 - DNA, 491 bp, Homo sapiens
  misc_feature: HIJSMM301DLW7R.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttgccagggaccaagctggagatcaaacgaactgtgg

SEQ ID NO: 595886 - DNA, 508 bp, Homo sapiens; identical to SEQ ID NO: 536388
  misc_feature: HIJSMM301EHTV0.11.57.F02.1.454.light.4.raw

SEQ ID NO: 595887 - DNA, 506 bp, Homo sapiens
  misc_feature: HIJSMM301EDPRP.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaagggcctgccccctcggtcta

SEQ ID NO: 595888 - DNA, 493 bp, Homo sapiens
  misc_feature: HIJSMM301DBMM3.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactgggctcaggcggaagatgaggctgactattactgtaactcccgggccagcagtggtaacattgtgatattcggcggagggaccaagctgaccgtcctaggtcagcccaaggctgccccctcggtcactc

SEQ ID NO: 595889 - DNA, 496 bp, Homo sapiens; identical to SEQ ID NO: 535109
  misc_feature: HIJSMM301AI4JN.16.78.H01.1.454.light.4.raw

SEQ ID NO: 595890 - DNA, 497 bp, Homo sapiens; identical to SEQ ID NO: 567078
  misc_feature: HIJSMM301EIHIB.26.26.C04.1.454.light.4.raw

SEQ ID NO: 595891 - DNA, 495 bp, Homo sapiens
  misc_feature: HIJSMM301ADVMH.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaacggtggaaagtacaaacgaaactacgtgg

SEQ ID NO: 595892 - DNA, 494 bp, Homo sapiens; identical to SEQ ID NO: 534992
  misc_feature: HIJSMM301EQWAB.9.1.A01.1.454.light.4.raw

SEQ ID NO: 595893 - DNA, 508 bp, Homo sapiens; identical to SEQ ID NO: 537871
  misc_feature: HIJSMM301DK223.8.33.C11.1.454.light.4.raw

SEQ ID NO: 595894 - DNA, 490 bp, Homo sapiens
  misc_feature: HIJSMM301BZFBP.49.72.G06.1.454.light.4.raw
agtcgagagacacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgt

SEQ ID NO: 595895 - DNA, 491 bp, Homo sapiens
  misc_feature: HIJSMM301DKT5T.49.33.C11.1.454.light.4.raw
agtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctccccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggaggatcaaacgaactgtggctgcaccat

SEQ ID NO: 595896 - DNA, 480 bp, Homo sapiens
  misc_feature: HIJSMM301B7MJ0.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttatactgtcagcagagttccaggaccccgctccactttcggcggggggtaccaaagtggacgtcaaacgaactgtggct

SEQ ID NO: 595897 - DNA, 503 bp, Homo sapiens; identical to SEQ ID NO: 578541
  misc_feature: HIJSMM301BKV3X.4.39.D06.1.454.light.4.raw

SEQ ID NO: 595898 - DNA, 487 bp, Homo sapiens
  misc_feature: HIJSMM301BF4OY.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccatctcgtctt

SEQ ID NO: 595899 - DNA, 521 bp, Homo sapiens
  misc_feature: HIJSMM301CZWYD.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactcctgttcccgccct

SEQ ID NO: 595900 - DNA, 518 bp, Homo sapiens; identical to SEQ ID NO: 554776
  misc_feature: HIJSMM301EC1CY.43.81.H04.1.454.light.4.raw

SEQ ID NO: 595901 - DNA, 496 bp, Homo sapiens; identical to SEQ ID NO: 538394
  misc_feature: HIJSMM301EP6MD.22.86.H09.1.454.light.4.raw

SEQ ID NO: 595902 - DNA, 463 bp, Homo sapiens; identical to SEQ ID NO: 535062
  misc_feature: HIJSMM301DHQNM.11.73.G07.1.454.light.4.raw

SEQ ID NO: 595903 - DNA, 505 bp, Homo sapiens
  misc_feature: HIJSMM301ARTMK.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccccac

SEQ ID NO: 595904 - DNA, 508 bp, Homo sapiens; identical to SEQ ID NO: 549157
  misc_feature: HIJSMM301D2RER.17.33.C11.1.454.light.4.raw

SEQ ID NO: 595905 - DNA, 504 bp, Homo sapiens
  misc_feature: HIJSMM301BLIGE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactggaccgtcctaggtcagccccaa

SEQ ID NO: 595906 - DNA, 500 bp, Homo sapiens
  misc_feature: HIJSMM301AFJQ6.5.40.D07.1.454.light.4.raw
atcagacacgcacgaccggtgctcgatttagtgatagagcggtaacaacagaggggaggaactgctcagttaggacccagacggaaccatggaagccccagcgcagcttctcttcctcctgctactctggctcccagataccattgggagagatagtgatgacgcagtctccagccaccctgtctgtgtctccaggggaaagagccaccctctcctgcgagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactgggtggacgttcggccgaacgggaccgaaggtagggagaccaaaccgaaactacgtggcgtgcaccactc

SEQ ID NO: 595907 - DNA, 483 bp, Homo sapiens; identical to SEQ ID NO: 540738
  misc_feature: HIJSMM301CIECG.48.85.H08.1.454.light.4.raw

SEQ ID NO: 595908 - DNA, 525 bp, Homo sapiens
  misc_feature: HIJSMM301DFJSB.16.59.F04.1.454.light.4.raw
tgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgagtagtaca

SEQ ID NO: 595909 - DNA, 484 bp, Homo sapiens; identical to SEQ ID NO: 541607
  misc_feature: HIJSMM301DBHRF.17.26.C04.1.454.light.4.raw

SEQ ID NO: 595910 - DNA, 473 bp, Homo sapiens
  misc_feature: HIJSMM301C6JMA.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgctaatttattactgtctgcaggattacacataccctcgaacgttcggccaaggaccgaaggtaggaaatacaaacgaactgt

SEQ ID NO: 595911 - DNA, 489 bp, Homo sapiens; identical to SEQ ID NO: 535139
  misc_feature: HIJSMM301EEGVP.14.55.E11.1.454.light.4.raw

SEQ ID NO: 595912 - DNA, 495 bp, Homo sapiens; identical to SEQ ID NO: 566148
  misc_feature: HIJSMM301BQ4CJ.51.38.D05.1.454.light.4.raw

SEQ ID NO: 595913 - DNA, 502 bp, Homo sapiens
  misc_feature: HIJSMM301BD70O.43.33.C11.1.454.light.4.raw
tgtgagtagtcacgaccggtgctcgatttagagtgagctcgttgggtttgggcggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacgggctctgagacagtattttctctcgtcatcactggtctacagtctgacgacggcgcaatgtacttctgtcaacactatgcctcctccccctacaatttcggtcagggaccaagttgaacatctaa

SEQ ID NO: 595914 - DNA, 485 bp, Homo sapiens; identical to SEQ ID NO: 535606
  misc_feature: HIJSMM301DV235.47.46.E02.1.454.light.4.raw

SEQ ID NO: 595915 - DNA, 508 bp, Homo sapiens; identical to SEQ ID NO: 576322
  misc_feature: HIJSMM301C38N4.8.38.D05.1.454.light.4.raw

SEQ ID NO: 595916 - DNA, 495 bp, Homo sapiens
  misc_feature: HIJSMM301BSNGT.48.23.C01.1.454.light.4.raw
agtatacatacacgaccggtgctcgatttagtacacgtgattagggattgggggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgcatctgatatgtatact

SEQ ID NO: 595917 - DNA, 500 bp, Homo sapiens
  misc_feature: HIJSMM301AH07E.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaggtcacgtcctggt

SEQ ID NO: 595918 - DNA, 511 bp, Homo sapiens
  misc_feature: HIJSMM301CA9XE.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacaggtattcggcggagggaccaagttgaccgtcctaggtcagcccaaggctgccccctcggtcactctgttcccacctccccg

SEQ ID NO: 595919 - DNA, 492 bp, Homo sapiens
  misc_feature: HIJSMM301CM42S.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggaacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggataatcagacgaa

SEQ ID NO: 595920 - DNA, 496 bp, Homo sapiens; identical to SEQ ID NO: 537925
  misc_feature: HIJSMM301ELFTA.22.14.B03.1.454.light.4.raw

SEQ ID NO: 595921 - DNA, 486 bp, Homo sapiens
  misc_feature: HIJSMM301CAQE4.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctcgttcccgccctcctctacgtgagct

SEQ ID NO: 595922 - DNA, 486 bp, Homo sapiens; identical to SEQ ID NO: 538754
  misc_feature: HIJSMM301CX13W.19.5.A05.1.454.light.4.raw

SEQ ID NO: 595923 - DNA, 488 bp, Homo sapiens
  misc_feature: HIJSMM301EYMHK.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagccaaggccaacccc

SEQ ID NO: 595924 - DNA, 520 bp, Homo sapiens
  misc_feature: HIJSMM301CM7E0.27.23.C01.1.454.light.4.raw
  modified_base (447)..(447): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggngttcggcggagggaccaggctgaccgtcctaggtcagcccaaggctgccccctcggtcactctgttcccacct

SEQ ID NO: 595925 - DNA, 512 bp, Homo sapiens
  misc_feature: HIJSMM301B364S.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactcttcg

SEQ ID NO: 595926 - DNA, 515 bp, Homo sapiens
  misc_feature: HIJSMM301CJ83V.7.5.A05.1.454.light.4.raw
  modified_base (332)..(332): a, c, t, g, unknown or other
  modified_base (487)..(487): a, c, t, g, unknown or other
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataaatcggccttcagggtttccgtaatcncttctctggtctccaagtctggcggacacggcctccctgaccactctctgggctccaggctgaagacgaggctgattattacttgcagctcatatacaggcagcagcactccaaggttttggccggagggaccaagcgttgaccgtcctaaggtnacgcccgaacggctcggccccctccggt

SEQ ID NO: 595927 - DNA, 493 bp, Homo sapiens; identical to SEQ ID NO: 536007
  misc_feature: HIJSMM301CGVSE.27.78.H01.1.454.light.4.raw

SEQ ID NO: 595928 - DNA, 497 bp, Homo sapiens; identical to SEQ ID NO: 540516
  misc_feature: HIJSMM301ER9SM.52.55.E11.1.454.light.4.raw

SEQ ID NO: 595929 - DNA, 492 bp, Homo sapiens
  misc_feature: HIJSMM301BAM8D.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaagggaaccgaaggtaggagtatctagacgaa

SEQ ID NO: 595930 - DNA, 496 bp, Homo sapiens; identical to SEQ ID NO: 579352
  misc_feature: HIJSMM301APCVI.22.14.B03.1.454.light.4.raw

SEQ ID NO: 595931 - DNA, 485 bp, Homo sapiens
  misc_feature: HIJSMM301DE5ML.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacaacgactggagattaaacgaactgtggctgcaccat

SEQ ID NO: 595932 - DNA, 503 bp, Homo sapiens; identical to SEQ ID NO: 537189
  misc_feature: HIJSMM301BS2L6.19.85.H08.1.454.light.4.raw

SEQ ID NO: 595933 - DNA, 494 bp, Homo sapiens; identical to SEQ ID NO: 534994
  misc_feature: HIJSMM301D046J.27.78.H01.1.454.light.4.raw

SEQ ID NO: 595934 - DNA, 479 bp, Homo sapiens
  misc_feature: HIJSMM301BVQGD.11.11.A11.1.454.light.4.raw
  modified_base (450)..(450): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccgggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatnagacgaactgtggctgcaccatctgtctt

SEQ ID NO: 595935 - DNA, 524 bp, Homo sapiens
  misc_feature: HIJSMM301CKS9A.9.12.B01.1.454.light.4.raw
tgatacgtctcacgaccggtgctcgatttagtagtgtagattccgcggggacaacgaggcagggcaggggcagcaagatggtgttgcagacccaggtcttcatttctctgttgctctcggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaactccggggtccctgaccgattcagtggcagcgggtctgggacagatttcactctcaccatcagcagcctgcaggctgaagatgtggcagtttattactgtcaactagttttctcgggcgtggtccaaggaccgaaggtaggaaagtacaaacgaaactacggtaggtcgtggcaccaactctcgttcttctactcttcccccg

SEQ ID NO: 595936 - DNA, 487 bp, Homo sapiens
  misc_feature: HIJSMM301CCFKX.5.39.D06.1.454.light.4.raw
atcagacacgcacgaccggtgctcgatttagtgacatctcgcagttctttgggcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaac

SEQ ID NO: 595937 - DNA, 507 bp, Homo sapiens
  misc_feature: HIJSMM301AI305.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccccatgtcta

SEQ ID NO: 595938 - DNA, 493 bp, Homo sapiens; identical to SEQ ID NO: 536246
  misc_feature: HIJSMM301BG65M.49.66.F11.1.454.light.4.raw

SEQ ID NO: 595939 - DNA, 517 bp, Homo sapiens; identical to SEQ ID NO: 469285
  misc_feature: HIJSMM301DTG72.46.67.G01.1.454.light.4.raw

SEQ ID NO: 595940 - DNA, 486 bp, Homo sapiens; identical to SEQ ID NO: 535043
  misc_feature: HIJSMM301CDPSV.46.35.D02.1.454.light.4.raw

SEQ ID NO: 595941 - DNA, 498 bp, Homo sapiens
  misc_feature: HIJSMM301C30ZN.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcta

SEQ ID NO: 595942 - DNA, 508 bp, Homo sapiens
  misc_feature: HIJSMM301ERHMX.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactagtcaacagcgtagcagcaggcctccggcgacgttcggccaagggaccaaggtggaagtcaagcgaactgtggctgcaccatctgtcttcatcttcccgcc

SEQ ID NO: 595943 - DNA, 500 bp, Homo sapiens
  misc_feature: HIJSMM301AZPCH.4.39.D06.1.454.light.4.raw
  modified_base (380)..(380): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtntctgggctccaggctgaggatgaggctgattattattgcagctcatatgcaggcagttacaatgtgatattcggcggagggaccaaactgaccgtctaggtcagcccaaggctgcccctc

SEQ ID NO: 595944 - DNA, 494 bp, Homo sapiens; identical to SEQ ID NO: 542031
  misc_feature: HIJSMM301AU40G.12.23.C01.1.454.light.4.raw

SEQ ID NO: 595945 - DNA, 501 bp, Homo sapiens; identical to SEQ ID NO: 536818
  misc_feature: HIJSMM301DXUQX.12.82.H05.1.454.light.4.raw

SEQ ID NO: 595946 - DNA, 444 bp, Homo sapiens; identical to SEQ ID NO: 534993
  misc_feature: HIJSMM301D9RPF.5.9.A09.1.454.light.4.raw

SEQ ID NO: 595947 - DNA, 501 bp, Homo sapiens
  misc_feature: HIJSMM301BB63G.41.38.D05.1.454.light.4.raw
tctatactatcacgaccggtgctcgatttagtatctgatagttgggtttgggggccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactagtggctgcaccatctgtcttcatcttccccg

SEQ ID NO: 595948 - DNA, 490 bp, Homo sapiens
  misc_feature: HIJSMM301AL6SQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggctaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 595949 - DNA, 476 bp, Homo sapiens
  misc_feature: HIJSMM301B6VVQ.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgactgtggctgcacatctgtcttcatcttcccgccatctgaagtatagtct

SEQ ID NO: 595950 - DNA, 490 bp, Homo sapiens; identical to SEQ ID NO: 543909
  misc_feature: HIJSMM301AOYGU.14.55.E11.1.454.light.4.raw

SEQ ID NO: 595951 - DNA, 486 bp, Homo sapiens; identical to SEQ ID NO: 535523
  misc_feature: HIJSMM301D2KYV.22.73.G07.1.454.light.4.raw

SEQ ID NO: 595952 - DNA, 502 bp, Homo sapiens; identical to SEQ ID NO: 539314
  misc_feature: HIJSMM301CZDAS.21.81.H04.1.454.light.4.raw

SEQ ID NO: 595953 - DNA, 508 bp, Homo sapiens; identical to SEQ ID NO: 556056
  misc_feature: HIJSMM301DYFTE.47.85.H08.1.454.light.4.raw

SEQ ID NO: 595954 - DNA, 485 bp, Homo sapiens
  misc_feature: HIJSMM301A26YF.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcggctccagtctgaggactctgcaacttattactgccaacaatatgatatttattctccagcgttcggccaggggaccaaggtggaagtcaagcgaactgtggctgcaccatct

SEQ ID NO: 595955 - DNA, 504 bp, Homo sapiens
  misc_feature: HIJSMM301AHS6U.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcca

SEQ ID NO: 595956 - DNA, 503 bp, Homo sapiens; identical to SEQ ID NO: 536002
  misc_feature: HIJSMM301A6TIW.51.23.C01.1.454.light.4.raw

SEQ ID NO: 595957 - DNA, 499 bp, Homo sapiens; identical to SEQ ID NO: 537739
  misc_feature: HIJSMM301AOQS4.12.86.H09.1.454.light.4.raw

SEQ ID NO: 595958 - DNA, 499 bp, Homo sapiens
  misc_feature: HIJSMM301BLDE5.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgaatctatgctgcatccactttacaaaatggagtcccatcaagattcagcggcagtggatctggcacagctttcactctcaccgtcagcagcctgcagtctgaagattttgctaacttattactgtctacaagattcttcttaccctcggacgttcggccgacgggaccgacggtcggagtgtctaagacgaactagtggcgtgcgaccactcttcg

SEQ ID NO: 595959 - DNA, 492 bp, Homo sapiens
  misc_feature: HIJSMM301A376H.49.58.F03.1.454.light.4.raw
agtcgagagacacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaacgaactgtggctgcacatctgtcttcatcttcccg

SEQ ID NO: 595960 - DNA, 489 bp, Homo sapiens; identical to SEQ ID NO: 535139
  misc_feature: HIJSMM301EU0T9.14.55.E11.1.454.light.4.raw

SEQ ID NO: 595961 - DNA, 513 bp, Homo sapiens; identical to SEQ ID NO: 543313
  misc_feature: HIJSMM301EML9U.22.36.D03.1.454.light.4.raw

SEQ ID NO: 595962 - DNA, 471 bp, Homo sapiens
  misc_feature: HIJSMM301AFRA3.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacaatatgataatctaccactcactttcggtcggagggaccgacggtggaggatcaaacgaa

SEQ ID NO: 595963 - DNA, 507 bp, Homo sapiens; identical to SEQ ID NO: 539817
  misc_feature: HIJSMM301CNMHI.5.24.C02.1.454.light.4.raw

SEQ ID NO: 595964 - DNA, 508 bp, Homo sapiens
  misc_feature: HIJSMM301EVMYM.10.29.C07.1.454.light.4.raw
catagtagtgcacgaccggtgctcgatttagagtgctacgaagggaaagggggggtcgtcaggaggcagcgctctcgggacggtctccaccatggcctgggctctgctattcctcaccctccctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctacgtcagcccaaggccaacccccactgtca

SEQ ID NO: 595965 - DNA, 490 bp, Homo sapiens; identical to SEQ ID NO: 541567
  misc_feature: HIJSMM301BZ96W.22.65.F10.1.454.light.4.raw

SEQ ID NO: 595966 - DNA, 509 bp, Homo sapiens; identical to SEQ ID NO: 537697
  misc_feature: HIJSMM301BOKDU.19.59.F04.1.454.light.4.raw

SEQ ID NO: 595967 - DNA, 517 bp, Homo sapiens; identical to SEQ ID NO: 555770
  misc_feature: HIJSMM301AFKYV.27.23.C01.1.454.light.4.raw

SEQ ID NO: 595968 - DNA, 490 bp, Homo sapiens
  misc_feature: HIJSMM301CSFFP.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgctagtttattactgtcagcaatataacaagtggccattcactttcggcccagggaccaagtggatatcaaacgaactgtggctgcaccatctgtcttcatt

SEQ ID NO: 595969 - DNA, 459 bp, Homo sapiens
  misc_feature: HIJSMM301CMQZQ.17.39.D06.1.454.light.4.raw
  modified_base (456)..(456): a, c, t, g, unknown or other
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctcgtgacgttcgcaggacagtgaatnaac

SEQ ID NO: 595970 - DNA, 443 bp, Homo sapiens; identical to SEQ ID NO: 560479
  misc_feature: HIJSMM301BNHAM.8.73.G07.1.454.light.4.raw

SEQ ID NO: 595971 - DNA, 503 bp, Homo sapiens; identical to SEQ ID NO: 535044
  misc_feature: HIJSMM301D2DIU.19.78.H01.1.454.light.4.raw

SEQ ID NO: 595972 - DNA, 494 bp, Homo sapiens; identical to SEQ ID NO: 534992
  misc_feature: HIJSMM301DL0MS.9.1.A01.1.454.light.4.raw

SEQ ID NO: 595973 - DNA, 502 bp, Homo sapiens; identical to SEQ ID NO: 537363
  misc_feature: HIJSMM301CW8ED.18.23.C01.1.454.light.4.raw

SEQ ID NO: 595974 - DNA, 496 bp, Homo sapiens
  misc_feature: HIJSMM301CDS04.9.53.E09.1.454.light.4.raw
tgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctc

SEQ ID NO: 595975 - DNA, 453 bp, Homo sapiens
  misc_feature: HIJSMM301EFLGR.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggctgccccctcggtcactctgttcccaccctcctccacgagagta

SEQ ID NO: 595976 - DNA, 512 bp, Homo sapiens; identical to SEQ ID NO: 588021
  misc_feature: HIJSMM301DOW2F.14.85.H08.1.454.light.4.raw

SEQ ID NO: 595977 - DNA, 505 bp, Homo sapiens
  misc_feature: HIJSMM301EHRJX.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctggtcactctgttcccgcctcc

SEQ ID NO: 595978 - DNA, 510 bp, Homo sapiens
  misc_feature: HIJSMM301D4CYJ.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctggtcact

SEQ ID NO: 595979 - DNA, 486 bp, Homo sapiens; identical to SEQ ID NO: 535043
  misc_feature: HIJSMM301DU8TI.46.35.D02.1.454.light.4.raw

SEQ ID NO: 595980 - DNA, 494 bp, Homo sapiens; identical to SEQ ID NO: 534992
  misc_feature: HIJSMM301ASO2S.9.1.A01.1.454.light.4.raw

SEQ ID NO: 595981 - DNA, 487 bp, Homo sapiens
  misc_feature: HIJSMM301BC2WF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattacttgtcagcagtatggtcacgtcccaagaacttttggccaggggaccaagctggagatcaaacgaactgtggctgcaccat

SEQ ID NO: 595982 - DNA, 505 bp, Homo sapiens; identical to SEQ ID NO: 535503
  misc_feature: HIJSMM301E1U11.8.28.C06.1.454.light.4.raw

SEQ ID NO: 595983 - DNA, 495 bp, Homo sapiens; identical to SEQ ID NO: 535007
  misc_feature: HIJSMM301CL4AE.22.5.A05.1.454.light.4.raw

SEQ ID NO: 595984 - DNA, 481 bp, Homo sapiens
  misc_feature: HIJSMM301ALDYI.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcagggaccgacgtggagtgtcagcgaactagtggctgcaccact

SEQ ID NO: 595985 - DNA, 521 bp, Homo sapiens; identical to SEQ ID NO: 536990
  misc_feature: HIJSMM301CT3H8.27.23.C01.1.454.light.4.raw
  modified_base (517)..(517): a, c, t, g, unknown or other

SEQ ID NO: 595986 - DNA, 485 bp, Homo sapiens; identical to SEQ ID NO: 542735
  misc_feature: HIJSMM301DHYJP.26.45.E01.1.454.light.4.raw

SEQ ID NO: 595987 - DNA, 495 bp, Homo sapiens; identical to SEQ ID NO: 548066
  misc_feature: HIJSMM301DJ9KW.3.31.C09.1.454.light.4.raw

SEQ ID NO: 595988 - DNA, 481 bp, Homo sapiens; identical to SEQ ID NO: 560403
  misc_feature: HIJSMM301DU9J0.4.74.G08.1.454.light.4.raw

SEQ ID NO: 595989 - DNA, 487 bp, Homo sapiens; identical to SEQ ID NO: 576586
  misc_feature: HIJSMM301C0ZMV.7.85.H08.1.454.light.4.raw

SEQ ID NO: 595990 - DNA, 480 bp, Homo sapiens; identical to SEQ ID NO: 542064
  misc_feature: HIJSMM301DSSSL.5.70.G04.1.454.light.4.raw

SEQ ID NO: 595991 - DNA, 504 bp, Homo sapiens; identical to SEQ ID NO: 538940
  misc_feature: HIJSMM301ATZTM.2.35.D02.1.454.light.4.raw

SEQ ID NO: 595992 - DNA, 477 bp, Homo sapiens
  misc_feature: HIJSMM301CWR6I.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttatactgtcagcagtatactaactggcctctgacgttcggccaagggaccagggtggaaatcaaacgaactgtggctgcacat

SEQ ID NO: 595993 - DNA, 499 bp, Homo sapiens
  misc_feature: HIJSMM301BGUPL.52.37.D04.1.454.light.4.raw
cgcagtacgacacgaccggtgctcgatttagtagcatactgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 595994 - DNA, 492 bp, Homo sapiens
  misc_feature: HIJSMM301D02GF.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatttcagcgactctaggagacaaggtcaacttctcctccaaagccagccaagacattgatgatgatatgaactggcaccaacacaaaccaggagaagctgctatttccattactcaagaaactaatggtctcctacctggaatgccactcgactcagtggcaacaaatatggaacagtttttaccctcacaactcatatcacagaatctgaggatgctgcattttacttcggtctacaacatgataatttccctccgtggacgttcggccaaggaccaaggagcaaatcaaacgactagtggctgcacatctgtcttcatctccgccat

SEQ ID NO: 595995 - DNA, 518 bp, Homo sapiens; identical to SEQ ID NO: 580721
  misc_feature: HIJSMM301CMHM0.43.59.F04.1.454.light.4.raw

SEQ ID NO: 595996 - DNA, 486 bp, Homo sapiens; identical to SEQ ID NO: 536261
  misc_feature: HIJSMM301AKLIK.26.55.E11.1.454.light.4.raw

SEQ ID NO: 595997 - DNA, 506 bp, Homo sapiens; identical to SEQ ID NO: 554661
  misc_feature: HIJSMM301E0MC1.3.79.H02.1.454.light.4.raw

SEQ ID NO: 595998 - DNA, 492 bp, Homo sapiens; identical to SEQ ID NO: 540272
  misc_feature: HIJSMM301C2L84.41.23.C01.1.454.light.4.raw

SEQ ID NO: 595999 - DNA, 491 bp, Homo sapiens; identical to SEQ ID NO: 545038
  misc_feature: HIJSMM301B5ETI.22.25.C03.1.454.light.4.raw

SEQ ID NO: 596000 - DNA, 483 bp, Homo sapiens
  misc_feature: HIJSMM301BW8Y7.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 596001 - DNA, 499 bp, Homo sapiens
  misc_feature: HIJSMM301APIE4.5.14.B03.1.454.light.4.raw
atcagacacgcacgaccggtgctcgatttagtgtgagtagttcccgggcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggaggga

SEQ ID NO: 596002 - DNA, 497 bp, Homo sapiens
  misc_feature: HIJSMM301A1O44.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaggaccaaggtggaaatacaaacgaactgtggctgcacc

SEQ ID NO: 596003 - DNA, 448 bp, Homo sapiens
  misc_feature: HIJSMM301CQMSI.18.9.A09.1.454.light.4.raw
tacgagtatgcacgaccggtgctcgatttagcgagacgcgcagggtccgtgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatcttggtagcaacaatcggccctcaggggtccctgaccgattctctggctccaagtctggcacctcagcctaccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 596004 - DNA, 486 bp, Homo sapiens; identical to SEQ ID NO: 536555
  misc_feature: HIJSMM301BL5UH.26.23.C01.1.454.light.4.raw

SEQ ID NO: 596005 - DNA, 507 bp, Homo sapiens
  misc_feature: HIJSMM301DKTH5.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtccaggtcagccaaggctgccccctcggtcactctgtt

SEQ ID NO: 596006 - DNA, 495 bp, Homo sapiens; identical to SEQ ID NO: 557386
  misc_feature: HIJSMM301A8NXW.27.78.H01.1.454.light.4.raw

SEQ ID NO: 596007 - DNA, 504 bp, Homo sapiens; identical to SEQ ID NO: 545953
  misc_feature: HIJSMM301CFS6P.8.28.C06.1.454.light.4.raw

SEQ ID NO: 596008 - DNA, 452 bp, Homo sapiens
  misc_feature: HIJSMM301DLF1O.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcgagggaccaagctgaccgtctaagtcagcccaaggctgccccctcggtcactctgttcccgccctcctccacgagagta

SEQ ID NO: 596009 - DNA, 494 bp, Homo sapiens; identical to SEQ ID NO: 534992
  misc_feature: HIJSMM301AMXOS.9.1.A01.1.454.light.4.raw

SEQ ID NO: 596010 - DNA, 491 bp, Homo sapiens
  misc_feature: HIJSMM301E26NX.19.15.B04.1.454.light.4.raw
tactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatagaaacgaactagtggctgcaccat

SEQ ID NO: 596011 - DNA, 488 bp, Homo sapiens; identical to SEQ ID NO: 537124
  misc_feature: HIJSMM301A901B.11.25.C03.1.454.light.4.raw

SEQ ID NO: 596012 - DNA, 502 bp, Homo sapiens; identical to SEQ ID NO: 541971
  misc_feature: HIJSMM301A5B3G.4.39.D06.1.454.light.4.raw

SEQ ID NO: 596013 - DNA, 486 bp, Homo sapiens; identical to SEQ ID NO: 535385
  misc_feature: HIJSMM301BAJTA.19.71.G05.1.454.light.4.raw

SEQ ID NO: 596014 - DNA, 508 bp, Homo sapiens; identical to SEQ ID NO: 541908
  misc_feature: HIJSMM301DVPH3.47.85.H08.1.454.light.4.raw

SEQ ID NO: 596015 - DNA, 490 bp, Homo sapiens
  misc_feature: HIJSMM301DP1KX.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgtcagaaaggttcagtggcagcgggtcagggacagatttcacactgaaaatcagccgggtgggggctgaggatgttggcatttattactgcatgcaggctatacaccttcctgcctacttttggccaggggaccaagctggagatcaggcgtaacg

SEQ ID NO: 596016 - DNA, 491 bp, Homo sapiens; identical to SEQ ID NO: 535176
  misc_feature: HIJSMM301APOB6.13.39.D06.1.454.light.4.raw

SEQ ID NO: 596017 - DNA, 508 bp, Homo sapiens
  misc_feature: HIJSMM301AOQ7H.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggacaaggtcaccgtcctaggtcagcccaaggcccaaccccactgtctac

SEQ ID NO: 596018 - DNA, 524 bp, Homo sapiens
  misc_feature: HIJSMM301AU1ED.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggagggaccaggctgaccgtcctaggtcagcccaaggctcgccccctcggtcactctgttcccgccctt

SEQ ID NO: 596019 - DNA, 498 bp, Homo sapiens
  misc_feature: HIJSMM301BN9QU.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcaccagggtggaggctgaggatgttgggatttattactgcatgcaagctacattctggccttttcacttttcggccctgggaccaaagtggataccaatcgaactgtggctgcaccatctgtt

SEQ ID NO: 596020 - DNA, 483 bp, Homo sapiens; identical to SEQ ID NO: 538138
  misc_feature: HIJSMM301AU2Q3.41.34.D01.1.454.light.4.raw

SEQ ID NO: 596021 - DNA, 503 bp, Homo sapiens; identical to SEQ ID NO: 572163
  misc_feature: HIJSMM301CLNCU.4.71.G05.1.454.light.4.raw

SEQ ID NO: 596022 - DNA, 524 bp, Homo sapiens
  misc_feature: HIJSMM301EMIXK.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggagtggtgttagtgatcgggctacttttcggcggagggacccagctgaccgtcctaggtcagcccaaggctcgccccctcggtcactctgttcccaccctcctcgagtacg

SEQ ID NO: 596023 - DNA, 488 bp, Homo sapiens; identical to SEQ ID NO: 569988
  misc_feature: HIJSMM301B0HXZ.26.55.E11.1.454.light.4.raw

SEQ ID NO: 596024 - DNA, 509 bp, Homo sapiens
  misc_feature: HIJSMM301CX64L.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagttagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttccggcggagggaccaaggtggacctcaaacgaactgtggctgcaccatctgtcttcatcttcccgccat

SEQ ID NO: 596025 - DNA, 505 bp, Homo sapiens
  misc_feature: HIJSMM301B0SN1.10.44.D11.1.454.light.4.raw
catagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtaggatagtacaaacgaactagtggtcgtgcaccatctgtcttc

SEQ ID NO: 596026 - DNA, 501 bp, Homo sapiens; identical to SEQ ID NO: 539914
  misc_feature: HIJSMM301DEB55.19.78.H01.1.454.light.4.raw

SEQ ID NO: 596027 - DNA, 444 bp, Homo sapiens; identical to SEQ ID NO: 550016
  misc_feature: HIJSMM301A6I7X.14.76.G10.1.454.light.4.raw

SEQ ID NO: 596028 - DNA, 503 bp, Homo sapiens
  misc_feature: HIJSMM301DNTLX.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgctagtttattactgtcagcagtataataactggcctcggacgttcggccgaacgggaccgaaggtggaagtacaaacgaactagtggcgtgcaccatctgtcttcactcttccccg

SEQ ID NO: 596029 - DNA, 501 bp, Homo sapiens; identical to SEQ ID NO: 538880
  misc_feature: HIJSMM301D224M.21.22.B11.1.454.light.4.raw

SEQ ID NO: 596030 - DNA, 521 bp, Homo sapiens
  misc_feature: HIJSMM301AEMHS.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaacggaccgaaggtggcaatcaaccgaactagtggctgcaccatctgtcttctatcttccccg

SEQ ID NO: 596031 - DNA, 522 bp, Homo sapiens
  misc_feature: HIJSMM301BHTL4.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtcgt

SEQ ID NO: 596032 - DNA, 505 bp, Homo sapiens
  misc_feature: HIJSMM301D8AUT.48.7.A07.1.454.light.4.raw
agtatacatacacgaccggtgctcgatttagcacgtgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttccccg

SEQ ID NO: 596033 - DNA, 504 bp, Homo sapiens; identical to SEQ ID NO: 555616
  misc_feature: HIJSMM301AXTY9.5.86.H09.1.454.light.4.raw

SEQ ID NO: 596034 - DNA, 447 bp, Homo sapiens; identical to SEQ ID NO: 535020
  misc_feature: HIJSMM301B6UGH.18.9.A09.1.454.light.4.raw

SEQ ID NO: 596035 - DNA, 491 bp, Homo sapiens; identical to SEQ ID NO: 535176
  misc_feature: HIJSMM301DT436.13.39.D06.1.454.light.4.raw

SEQ ID NO: 596036 - DNA, 522 bp, Homo sapiens
  misc_feature: HIJSMM301CPAV1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggcctgccccctcggtcactctgttcccgccct

SEQ ID NO: 596037 - DNA, 502 bp, Homo sapiens
  misc_feature: HIJSMM301EKBK8.48.52.E08.1.454.light.4.raw
agtatacatacacgaccggtgctcgatttagtcgagctctcccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgcccccc

SEQ ID NO: 596038 - DNA, 471 bp, Homo sapiens
  misc_feature: HIJSMM301B0XSQ.40.1.A01.1.454.light.4.raw
tctagcgactcacgaccggtgctcgatttagacgtctcatcaggggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaccagggaaagcccctaaagctcctgatctacgatgcatctaagttggaaacaggggtctcatcaaggttcagtggaagtggatctgggacagaattcgctctcaccatcagcagcctgcagcctgatgattttgcaacttattactgtccaacactatgatagttattctccgtacaccctttggtccaggggaccaaggtcggagagtcaagcgaa

SEQ ID NO: 596039 - DNA, 485 bp, Homo sapiens
  misc_feature: HIJSMM301B09I8.46.35.D02.1.454.light.4.raw
  modified_base (463)..(463): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccagggaccaagctggagactnaaacgaactgtggctgcaccat

SEQ ID NO: 596040 - DNA, 487 bp, Homo sapiens
  misc_feature: HIJSMM301DZ3HV.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgctagtctattactgtcagcagtatggtcacgtcccaagtaacttttggccagggaccaagctggagatacaaacgaactgtgctgcaccat

SEQ ID NO: 596041 - DNA, 511 bp, Homo sapiens; identical to SEQ ID NO: 560632
  misc_feature: HIJSMM301EILWV.14.85.H08.1.454.light.4.raw

SEQ ID NO: 596042 - DNA, 488 bp, Homo sapiens; identical to SEQ ID NO: 537673
  misc_feature: HIJSMM301EHS26.12.31.C09.1.454.light.4.raw

SEQ ID NO: 596043 - DNA, 513 bp, Homo sapiens
  misc_feature: HIJSMM301ADAJY.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtcgggaccgaaggtggagatcaaacgaactagtggctgcaccactctgtcttcta

SEQ ID NO: 596044 - DNA, 487 bp, Homo sapiens
  misc_feature: HIJSMM301DLES7.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcggccaagggtaccaaggtggacatcagacgaactgtggctgcacc

SEQ ID NO: 596045 - DNA, 508 bp, Homo sapiens; identical to SEQ ID NO: 536388
  misc_feature: HIJSMM301D4HCS.11.57.F02.1.454.light.4.raw

SEQ ID NO: 596046 - DNA, 505 bp, Homo sapiens
  misc_feature: HIJSMM301CNRAV.48.45.E01.1.454.light.4.raw
agtatacatacacgaccggtgctcgatttagtgagtcagtaagggaaagggggaagagctgctcagttaggacccagagggaaccatggaaaccccagcgcagcttctcttcctcctgctactctggctcccagataccgccggagaaattttgttgacgcagtctccaggcaccctgtctttgtctccaggggaaagagccaccctctcctgcagggccagtcagtatgttagcagcaactacttagcctggtaccagcagaaacctggccaggctcccaggctcctcatctacggtgcatccagcagggccattggcatcccagacaggttcagtggcagtgggtctgggacaaacttcactctcaccatcagcagactggagcctgaagattttgcagtctattactgtcagcagtatactaactcacctaagacgttcggccaagggaccaaggtggaaatcaaacgaactgtggctgcaccatctgtcttcatcttcccg

SEQ ID NO: 596047 - DNA, 479 bp, Homo sapiens
  misc_feature: HIJSMM301BA2UA.48.28.C06.1.454.light.4.raw
agtatacatacacgaccggtgctcgatttagagctcacgtattgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcacataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 596048 - DNA, 485 bp, Homo sapiens; identical to SEQ ID NO: 535501
  misc_feature: HIJSMM301A6KG9.3.10.A10.1.454.light.4.raw

SEQ ID NO: 596049 - DNA, 482 bp, Homo sapiens; identical to SEQ ID NO: 544665
  misc_feature: HIJSMM301BSIQK.8.14.B03.1.454.light.4.raw

SEQ ID NO: 596050 - DNA, 493 bp, Homo sapiens
  misc_feature: HIJSMM301EF73T.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactccctcggactttcggcggagggaccgaacggtggagatacaaacgaacct

SEQ ID NO: 596051 - DNA, 469 bp, Homo sapiens; identical to SEQ ID NO: 536091
  misc_feature: HIJSMM301CPMHW.3.82.H05.1.454.light.4.raw

SEQ ID NO: 596052 - DNA, 495 bp, Homo sapiens
  misc_feature: HIJSMM301DSRE7.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaacttattactgccaacagtatcatcatcattgtaatttcgggtggagggaccaaggtggaggtcaaacgaactgtggctgcacctatctgtcttcactt

SEQ ID NO: 596053 - DNA, 509 bp, Homo sapiens; identical to SEQ ID NO: 547302
  misc_feature: HIJSMM301CBRC9.4.57.F02.1.454.light.4.raw

SEQ ID NO: 596054 - DNA, 489 bp, Homo sapiens
  misc_feature: HIJSMM301D3EUU.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcgcaaggaccaaggtagaagtacaaacgaactgtgg

SEQ ID NO: 596055 - DNA, 506 bp, Homo sapiens
  misc_feature: HIJSMM301DN4GJ.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggaccaaccccta

SEQ ID NO: 596056 - DNA, 478 bp, Homo sapiens; identical to SEQ ID NO: 544068
  misc_feature: HIJSMM301BV0WG.13.59.F04.1.454.light.4.raw

SEQ ID NO: 596057 - DNA, 480 bp, Homo sapiens
  misc_feature: HIJSMM301EO9M5.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagccccg

SEQ ID NO: 596058 - DNA, 519 bp, Homo sapiens
  misc_feature: HIJSMM301DTTWO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaagtacaaacgaactacgtggcgtgcaccactctgtcttctactcttcccgtcccact

SEQ ID NO: 596059 - DNA, 506 bp, Homo sapiens; identical to SEQ ID NO: 554661
  misc_feature: HIJSMM301C95C5.3.79.H02.1.454.light.4.raw

SEQ ID NO: 596060 - DNA, 484 bp, Homo sapiens; identical to SEQ ID NO: 535240
  misc_feature: HIJSMM301B0S1O.47.60.F05.1.454.light.4.raw

SEQ ID NO: 596061 - DNA, 491 bp, Homo sapiens
  misc_feature: HIJSMM301ADEK6.14.55.E11.1.454.light.4.raw
cgtctagtaccacgaccggtgctcgatttagcactcgcacgttgggtttgggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactacttgtcaacagagttacagtacccccctcactttcggcggagggaccaaggcggagatcagacgaactgtggctgcaccatctgtcttcta

SEQ ID NO: 596062 - DNA, 464 bp, Homo sapiens
  misc_feature: HIJSMM301DJ4GG.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaaacagccgggtggagagtgaccatgttggaacttata

SEQ ID NO: 596063 - DNA, 447 bp, Homo sapiens; identical to SEQ ID NO: 535201
  misc_feature: HIJSMM301EI1LT.18.9.A09.1.454.light.4.raw

SEQ ID NO: 596064 - DNA, 497 bp, Homo sapiens; identical to SEQ ID NO: 545786
  misc_feature: HIJSMM301EUE9Z.48.59.F04.1.454.light.4.raw

SEQ ID NO: 596065 - DNA, 514 bp, Homo sapiens; identical to SEQ ID NO: 547648
  misc_feature: HIJSMM301D3SUY.16.1.A01.1.454.light.4.raw

SEQ ID NO: 596066 - DNA, 479 bp, Homo sapiens
  misc_feature: HIJSMM301A3EDN.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaatgaactgtggctgca

SEQ ID NO: 596067 - DNA, 511 bp, Homo sapiens
  misc_feature: HIJSMM301EPJN4.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtctaggtcagcccaaggccaaccccactgtcactctccg

SEQ ID NO: 596068 - DNA, 486 bp, Homo sapiens; identical to SEQ ID NO: 535290
  misc_feature: HIJSMM301A6I5R.3.12.B01.1.454.light.4.raw

SEQ ID NO: 596069 - DNA, 483 bp, Homo sapiens; identical to SEQ ID NO: 536697
  misc_feature: HIJSMM301EIQO9.46.26.C04.1.454.light.4.raw

SEQ ID NO: 596070 - DNA, 479 bp, Homo sapiens; identical to SEQ ID NO: 537235
  misc_feature: HIJSMM301CWJAO.22.59.F04.1.454.light.4.raw

SEQ ID NO: 596071 - DNA, 521 bp, Homo sapiens; identical to SEQ ID NO: 539470
  misc_feature: HIJSMM301A2LQH.27.23.C01.1.454.light.4.raw

SEQ ID NO: 596072 - DNA, 454 bp, Homo sapiens; identical to SEQ ID NO: 534964
  misc_feature: HIJSMM301DOTOX.19.86.H09.1.454.light.4.raw

SEQ ID NO: 596073 - DNA, 514 bp, Homo sapiens; identical to SEQ ID NO: 541418
  misc_feature: HIJSMM301EYCN8.17.33.C11.1.454.light.4.raw

SEQ ID NO: 596074 - DNA, 523 bp, Homo sapiens
  misc_feature: HIJSMM301B8A1O.27.23.C01.1.454.light.4.raw
  modified_base (227)..(227): a, c, t, g, unknown or other
  modified_base (495)..(495): a, c, t, g, unknown or other
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccagggtttctgatcgcttctatggctccaagtctgcctacacggcctccctgaccatctccgggctccagcctgaggacgaggctgattattattgtagttcatatacaaccaagtgacacttgggtgttcggcggagggaccaggctgaccgtccgtaggtcagcccaaggcngccccctcggtcactctgttcccgccct

SEQ ID NO: 596075 - DNA, 504 bp, Homo sapiens; identical to SEQ ID NO: 549905
  misc_feature: HIJSMM301ANWPV.48.71.G05.1.454.light.4.raw

SEQ ID NO: 596076 - DNA, 487 bp, Homo sapiens; identical to SEQ ID NO: 536536
  misc_feature: HIJSMM301AM8V8.26.45.E01.1.454.light.4.raw

SEQ ID NO: 596077 - DNA, 485 bp, Homo sapiens
  misc_feature: HIJSMM301EUV9A.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctcggtcactctgtcccgccctcctctacgtgagct

SEQ ID NO: 596078 - DNA, 484 bp, Homo sapiens; identical to SEQ ID NO: 547680
  misc_feature: HIJSMM301CLWGH.3.10.A10.1.454.light.4.raw

SEQ ID NO: 596079 - DNA, 494 bp, Homo sapiens; identical to SEQ ID NO: 536444
  misc_feature: HIJSMM301CZH82.26.72.G06.1.454.light.4.raw

SEQ ID NO: 596080 - DNA, 487 bp, Homo sapiens
  misc_feature: HIJSMM301EL56S.49.87.H10.1.454.light.4.raw
agtcgagagacacgaccggtgctcgatttagcagtactgcgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctccg

SEQ ID NO: 596081 - DNA, 493 bp, Homo sapiens; identical to SEQ ID NO: 535084
  misc_feature: HIJSMM301DTTQT.47.64.F09.1.454.light.4.raw

SEQ ID NO: 596082 - DNA, 520 bp, Homo sapiens
  misc_feature: HIJSMM301AXTB6.16.66.F11.1.454.light.4.raw
tgtactactccacgaccggtgctcgatttagtcacgcgagaagggtgagaagtagtggagcccaggccatagtggggatgctccaggctctgcttcctgagctaccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgcccccc

SEQ ID NO: 596083 - DNA, 474 bp, Homo sapiens
  misc_feature: HIJSMM301BJMVV.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaaggtggggtcccatcaagattcagtggcagtggatctgggacagatttcactctcgccatcagtagtctgcaacctgatgattttgcaacttactactgtcaacagagttccactaccccaatcacttcggcctggactgaagtgcatatgaagagaactgtggctgca

SEQ ID NO: 596084 - DNA, 494 bp, Homo sapiens; identical to SEQ ID NO: 534992
  misc_feature: HIJSMM301BDHWL.9.1.A01.1.454.light.4.raw

SEQ ID NO: 596085 - DNA, 486 bp, Homo sapiens; identical to SEQ ID NO: 535385
  misc_feature: HIJSMM301CF0JK.19.71.G05.1.454.light.4.raw

SEQ ID NO: 596086 - DNA, 497 bp, Homo sapiens; identical to SEQ ID NO: 571085
  misc_feature: HIJSMM301BG9X0.5.24.C02.1.454.light.4.raw

SEQ ID NO: 596087 - DNA, 446 bp, Homo sapiens
  misc_feature: HIJSMM301BIAZE.47.85.H08.1.454.light.4.raw
agctcacgtacacgaccggtgctcgatttagtatcactcagtcggcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccaccctcctctacgtgagct

SEQ ID NO: 596088 - DNA, 493 bp, Homo sapiens
  misc_feature: HIJSMM301BGGN5.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaagggtggagatacaaacgaactgtggctgcaccat

SEQ ID NO: 596089 - DNA, 506 bp, Homo sapiens
  misc_feature: HIJSMM301EAHU2.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttccccgccctcctccgtgt

SEQ ID NO: 596090 - DNA, 502 bp, Homo sapiens
  misc_feature: HIJSMM301CZLNT.15.66.F11.1.454.light.4.raw
  modified_base (482)..(482): a, c, t, g, unknown or other
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgactcgcttctctggctccaagtctggcgactcggcctcctgaccgtctctgggctccagcctgaagatgaggctgattatttctgcggctcatatggagacaattacagctttgtcttcggaagtgggaccaaggtcaccgtcctaagtcagcccaaggccaacccnctgtcactctgttcccacct

SEQ ID NO: 596091 - DNA, 495 bp, Homo sapiens; identical to SEQ ID NO: 556093
  misc_feature: HIJSMM301B8F91.16.6.A06.1.454.light.4.raw

SEQ ID NO: 596092 - DNA, 484 bp, Homo sapiens; identical to SEQ ID NO: 535240
  misc_feature: HIJSMM301BR5I4.47.60.F05.1.454.light.4.raw

SEQ ID NO: 596093 - DNA, 518 bp, Homo sapiens
  misc_feature: HIJSMM301DVEBI.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctcgccccctcggtcactctcgttcccacctcctccacg

SEQ ID NO: 596094 - DNA, 489 bp, Homo sapiens
  misc_feature: HIJSMM301EPG6H.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattcttcggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaagg

SEQ ID NO: 596095 - DNA, 511 bp, Homo sapiens; identical to SEQ ID NO: 550438
  misc_feature: HIJSMM301EWXEQ.17.33.C11.1.454.light.4.raw

SEQ ID NO: 596096 - DNA, 488 bp, Homo sapiens; identical to SEQ ID NO: 537673
  misc_feature: HIJSMM301BIN8P.12.31.C09.1.454.light.4.raw

SEQ ID NO: 596097 - DNA, 489 bp, Homo sapiens
  misc_feature: HIJSMM301APZB0.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaacgggaccaaggtaggagtatcagacgaa

SEQ ID NO: 596098 - DNA, 486 bp, Homo sapiens; identical to SEQ ID NO: 535043
  misc_feature: HIJSMM301BHN7N.46.35.D02.1.454.light.4.raw

SEQ ID NO: 596099 - DNA, 490 bp, Homo sapiens; identical to SEQ ID NO: 541141
  misc_feature: HIJSMM301B24DS.47.38.D05.1.454.light.4.raw

SEQ ID NO: 596100 - DNA, 494 bp, Homo sapiens; identical to SEQ ID NO: 534994
  misc_feature: HIJSMM301ENNTY.27.78.H01.1.454.light.4.raw

SEQ ID NO: 596101 - DNA, 501 bp, Homo sapiens; identical to SEQ ID NO: 536142
  misc_feature: HIJSMM301DX0ZO.15.1.A01.1.454.light.4.raw

SEQ ID NO: 596102 - DNA, 503 bp, Homo sapiens; identical to SEQ ID NO: 536834
  misc_feature: HIJSMM301A1UE9.2.35.D02.1.454.light.4.raw

SEQ ID NO: 596103 - DNA, 487 bp, Homo sapiens; identical to SEQ ID NO: 547557
  misc_feature: HIJSMM301CO2MA.7.75.G09.1.454.light.4.raw

SEQ ID NO: 596104 - DNA, 489 bp, Homo sapiens
  misc_feature: HIJSMM301DCPGL.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtcaacaatattattatacttcgtggtacgttcggccgaagggaccaaggtggatatcagacgaa

SEQ ID NO: 596105 - DNA, 507 bp, Homo sapiens; identical to SEQ ID NO: 563344
  misc_feature: HIJSMM301EXP23.3.79.H02.1.454.light.4.raw

SEQ ID NO: 596106 - DNA, 490 bp, Homo sapiens
  misc_feature: HIJSMM301E0IYI.26.23.C01.1.454.light.4.raw
  modified_base (480)..(480): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaaggtcaagcgaactgtggctgnaccatctgtt

SEQ ID NO: 596107 - DNA, 384 bp, Homo sapiens
  misc_feature: HIJSMM301EP6MS.41.25.C03.1.454.light.4.raw
tctatactatcacgaccggtgctcgatttagtagtgtagatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaaactttcggcggagggaccaaggtggagatcaaacgaactgtggctgcaccatctgtcttcatcttcccgccatctgaatagtataga

SEQ ID NO: 596108 - DNA, 484 bp, Homo sapiens; identical to SEQ ID NO: 535240
  misc_feature: HIJSMM301A7LVA.47.60.F05.1.454.light.4.raw

SEQ ID NO: 596109 - DNA, 507 bp, Homo sapiens; identical to SEQ ID NO: 577580
  misc_feature: HIJSMM301EB16N.15.86.H09.1.454.light.4.raw

SEQ ID NO: 596110 - DNA, 512 bp, Homo sapiens; identical to SEQ ID NO: 541300
  misc_feature: HIJSMM301AQD1U.17.33.C11.1.454.light.4.raw

SEQ ID NO: 596111 - DNA, 509 bp, Homo sapiens
  misc_feature: HIJSMM301BBELY.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccacggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatcacgggacgcaaccagtgggattgacaatctagaggcggttgggtgttcggcggagggaccaaactgaccgtcctaggtcagcccaa

SEQ ID NO: 596112 - DNA, 502 bp, Homo sapiens; identical to SEQ ID NO: 541971
  misc_feature: HIJSMM301AMAV1.4.39.D06.1.454.light.4.raw

SEQ ID NO: 596113 - DNA, 494 bp, Homo sapiens; identical to SEQ ID NO: 534992
  misc_feature: HIJSMM301EZ7EV.9.1.A01.1.454.light.4.raw

SEQ ID NO: 596114 - DNA, 496 bp, Homo sapiens
  misc_feature: HIJSMM301AKD88.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcgggcggagggaccaagctgaccgtcctaggtcagcccaa

SEQ ID NO: 596115 - DNA, 505 bp, Homo sapiens; identical to SEQ ID NO: 535503
  misc_feature: HIJSMM301C6ZUY.8.28.C06.1.454.light.4.raw

SEQ ID NO: 596116 - DNA, 506 bp, Homo sapiens
  misc_feature: HIJSMM301BUBAE.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgacccttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtaga

SEQ ID NO: 596117 - DNA, 463 bp, Homo sapiens; identical to SEQ ID NO: 535062
  misc_feature: HIJSMM301BN0TK.11.73.G07.1.454.light.4.raw

SEQ ID NO: 596118 - DNA, 476 bp, Homo sapiens; identical to SEQ ID NO: 548126
  misc_feature: HIJSMM301DK1D8.4.10.A10.1.454.light.4.raw

SEQ ID NO: 596119 - DNA, 494 bp, Homo sapiens; identical to SEQ ID NO: 534994
  misc_feature: HIJSMM301EJPNQ.27.78.H01.1.454.light.4.raw

SEQ ID NO: 596120 - DNA, 464 bp, Homo sapiens; identical to SEQ ID NO: 536640
  misc_feature: HIJSMM301ES0B4.26.78.H01.1.454.light.4.raw

SEQ ID NO: 596121 - DNA, 520 bp, Homo sapiens
  misc_feature: HIJSMM301D3KX1.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcgaatcaaccgaactagtggctgcaccatctgtcttcatcttccccg

SEQ ID NO: 596122 - DNA, 514 bp, Homo sapiens
  misc_feature: HIJSMM301AOKN9.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatggatgacagcctgagtggtccttgggtgttcggcggagggaccaagctgaccgtcctaagtcagcccaaggctgccccctcggtcactctgttcccgccctcctcg

SEQ ID NO: 596123 - DNA, 514 bp, Homo sapiens
  misc_feature: HIJSMM301AWNWO.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaggctggccgtcctaggtcagcccaaggctgccccctcggtcactctgttcccgccctcctcgagtagtaca

SEQ ID NO: 596124 - DNA, 453 bp, Homo sapiens; identical to SEQ ID NO: 536654
  misc_feature: HIJSMM301EGAG0.19.86.H09.1.454.light.4.raw

SEQ ID NO: 596125 - DNA, 503 bp, Homo sapiens
  misc_feature: HIJSMM301C2VFI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatcaaacgaacagtggctgcaccatctgtcttcatcttccccg

SEQ ID NO: 596126 - DNA, 444 bp, Homo sapiens; identical to SEQ ID NO: 535027
  misc_feature: HIJSMM301BVD8O.8.73.G07.1.454.light.4.raw

SEQ ID NO: 596127 - DNA, 509 bp, Homo sapiens
  misc_feature: HIJSMM301BHJQB.13.73.G07.1.454.light.4.raw
tcacgtactacacgaccggtgctcgatttagctctacgctcaggggggggtcacaagaggcagcgctctcgggacgtctccaccatggcctgggctctgctgctctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaacccactgtcactctgttcccca

SEQ ID NO: 596128 - DNA, 483 bp, Homo sapiens
  misc_feature: HIJSMM301C2KGN.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcataatcttatcgggtgttcggcggagggaccaagctgaccgtcta

SEQ ID NO: 596129 - DNA, 483 bp, Homo sapiens; identical to SEQ ID NO: 561886
  misc_feature: HIJSMM301ARI12.40.83.H06.1.454.light.4.raw

SEQ ID NO: 596130 - DNA, 493 bp, Homo sapiens
  misc_feature: HIJSMM301EFPVI.10.77.G11.1.454.light.4.raw
catagtagtgcacgaccggtgctcgatttagctagtcactcaaggggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcaggtggcagtgggtctgggacagacttcactctcaccatcagcagactagagcctgaagtattttgcagtttattactgtcagcagcgtagctaactggcctcggacgttcggccgaagggacgaaagtaggacagtcaagcgaacgtgtaggctgcacc

SEQ ID NO: 596131 - DNA, 499 bp, Homo sapiens
  misc_feature: HIJSMM301BBKHR.48.23.C01.1.454.light.4.raw
agtatacatacacgaccggtgctcgatttagtacacgtgattagggattgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctggtca

SEQ ID NO: 596132 - DNA, 505 bp, Homo sapiens
  misc_feature: HIJSMM301EMKLO.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagcccaaggctcgccccctggt

SEQ ID NO: 596133 - DNA, 492 bp, Homo sapiens
  misc_feature: HIJSMM301ET8YH.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccgagggtggagatcagacgaactgtggctgcaccatctgt

SEQ ID NO: 596134 - DNA, 496 bp, Homo sapiens
  misc_feature: HIJSMM301A2BS4.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaaacgaactgtggctgcaccatctgttcttcatccttcccg

SEQ ID NO: 596135 - DNA, 520 bp, Homo sapiens
  misc_feature: HIJSMM301CVAW1.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccaccctcctccgt

SEQ ID NO: 596136 - DNA, 428 bp, Homo sapiens
  misc_feature: HIJSMM301EUYR7.41.35.D02.1.454.light.4.raw
tctatactatcacgaccggtgctcgatttagcacacgatagttgggtttgggggctcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctgttcccgccctcctcatagtataga

SEQ ID NO: 596137 - DNA, 488 bp, Homo sapiens
  misc_feature: HIJSMM301CQITE.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaacgcccctaacctcctgatctatgctgcatccagtttgcataggtggggtcccatctaggttcagtggcagtggatctgggacagatttcactctcaccatcagcagtctgcaacctgaagattttgcaacttactactgtcaacagagttacggtacccgtacctacttttggccaggggaccaaactggacatcaaacgaactgtggctgcaccatct

SEQ ID NO: 596138 - DNA, 520 bp, Homo sapiens
  misc_feature: HIJSMM301E0T7E.22.15.B04.1.454.light.4.raw
acatacgcgtcacgaccggtgctcgatttagacagtatatatccgcggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactctgttcccgccct

SEQ ID NO: 596139 - DNA, 511 bp, Homo sapiens
  misc_feature: HIJSMM301EZY3U.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgcgaggctgatttttactgctgctcatatgcaggtgatcacactttttatgttcgggactgggaccaaggtcaccgtcctaggtcagcccaaggccaacccactgtcactctcg

SEQ ID NO: 596140 - DNA, 508 bp, Homo sapiens
  misc_feature: HIJSMM301CHFHW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaatacaaacgaaactcgtggctggcaccatctgtcttcatcttccccg

SEQ ID NO: 596141 - DNA, 499 bp, Homo sapiens
  misc_feature: HIJSMM301C1NI2.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagcccaaggctgccccctcggtcactctgttccc

SEQ ID NO: 596142 - DNA, 502 bp, Homo sapiens
  misc_feature: HIJSMM301A6WW0.40.80.H03.1.454.light.4.raw
tctagcgactcacgaccggtgctcgatttagctgtgcgtcgaagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcgggcggagggaccaagctgaccgtcctaggtcagcccaaggcctgccccctcggtca

SEQ ID NO: 596143 - DNA, 504 bp, Homo sapiens; identical to SEQ ID NO: 535561
  misc_feature: HIJSMM301EXHWJ.4.57.F02.1.454.light.4.raw

SEQ ID NO: 596144 - DNA, 441 bp, Homo sapiens; identical to SEQ ID NO: 534971
  misc_feature: HIJSMM301AD0V1.11.3.A03.1.454.light.4.raw

SEQ ID NO: 596145 - DNA, 497 bp, Homo sapiens
  misc_feature: HIJSMM301A47VB.11.60.F05.1.454.light.4.raw
cgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaaacctggccaggctcccaggctcctcttctatggtgcatccaacagggccgctggtatcccagccaggttcagtggcagtgggtctgcgacagagttcactctcaccatcagcagtctgcagtctgaagattttgcagtttattactgtcagcagtataatgactggcctcccacgtggacgttcggccaaggaccaaggtggaaatcaaacgaactagtggctgcaccatctgtctt

SEQ ID NO: 596146 - DNA, 447 bp, Homo sapiens; identical to SEQ ID NO: 535201
  misc_feature: HIJSMM301DS6K7.18.9.A09.1.454.light.4.raw

SEQ ID NO: 596147 - DNA, 513 bp, Homo sapiens
  misc_feature: HIJSMM301DH5CC.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggcccactggcatcccagccaggttcagtggcagtgggtatgggacagacttcactctcaccatcatcagcctggagcctgaggatgttgcagtttattactgtcaacatcgtaccgagtggccgtccggggccacgtttcggcccgtcgggaccaaagtggatatacaaacgaactgtggctgcaccatctgtcttcta

SEQ ID NO: 596148 - DNA, 490 bp, Homo sapiens
  misc_feature: HIJSMM301BZQCD.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttgggaatttattactgtatgcaaggtatagagcttcctccgacgttcggccaagggaccaaggtcggaactacaaacgaa

SEQ ID NO: 596149 - DNA, 487 bp, Homo sapiens
  misc_feature: HIJSMM301B8XZO.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcaggacccaggctattgatgaggctgtctacttctgtcaggcgtgggacaacagcgtggtgttcggcggaggaccagtctgaccgtcttaggtcagcccaa

SEQ ID NO: 596150 - DNA, 494 bp, Homo sapiens; identical to SEQ ID NO: 537091
  misc_feature: HIJSMM301DOAYE.27.78.H01.1.454.light.4.raw
  modified_base (426)..(426): a, c, t, g, unknown or other

SEQ ID NO: 596151 - DNA, 447 bp, Homo sapiens; identical to SEQ ID NO: 535201
  misc_feature: HIJSMM301AOF1B.18.9.A09.1.454.light.4.raw

SEQ ID NO: 596152 - DNA, 500 bp, Homo sapiens; identical to SEQ ID NO: 540219
  misc_feature: HIJSMM301EF94Y.43.34.D01.1.454.light.4.raw

SEQ ID NO: 596153 - DNA, 497 bp, Homo sapiens; identical to SEQ ID NO: 536371
  misc_feature: HIJSMM301E2TIY.16.78.H01.1.454.light.4.raw

SEQ ID NO: 596154 - DNA, 488 bp, Homo sapiens
  misc_feature: HIJSMM301AJNHD.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactctccgaggctcactttcggcggagggaccaaggtggagatcaaacgaactgt

SEQ ID NO: 596155 - DNA, 509 bp, Homo sapiens
  misc_feature: HIJSMM301EUYLW.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtaggaattacaaccgaactagtggctgcaccatctgtcttcatcttcccg

SEQ ID NO: 596156 - DNA, 492 bp, Homo sapiens
  misc_feature: HIJSMM301BXK1C.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggaccgttcggccgagggaccgacggtcggagtgtcaagacgaactgtggctgcaccatcttcg

SEQ ID NO: 596157 - DNA, 504 bp, Homo sapiens
  misc_feature: HIJSMM301CB5Y8.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtctaggtcagcccaaggctgccccctcggtcact

SEQ ID NO: 596158 - DNA, 505 bp, Homo sapiens
  misc_feature: HIJSMM301DGVDF.13.25.C03.1.454.light.4.raw
tcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggtccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtcactc

SEQ ID NO: 596159 - DNA, 494 bp, Homo sapiens
  misc_feature: HIJSMM301AEFMZ.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtctcggactggaccagtcacgtctaggtccagcccaacgcaccc

SEQ ID NO: 596160 - DNA, 446 bp, Homo sapiens
  misc_feature: HIJSMM301CERGI.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctcgttcccacctcctccatactcgta

SEQ ID NO: 596161 - DNA, 499 bp, Homo sapiens; identical to SEQ ID NO: 545732
  misc_feature: HIJSMM301AQ2M0.3.33.C11.1.454.light.4.raw

SEQ ID NO: 596162 - DNA, 507 bp, Homo sapiens; identical to SEQ ID NO: 563344
  misc_feature: HIJSMM301BUHO9.3.79.H02.1.454.light.4.raw

SEQ ID NO: 596163 - DNA, 509 bp, Homo sapiens; identical to SEQ ID NO: 541829
  misc_feature: HIJSMM301DX3KF.17.28.C06.1.454.light.4.raw

SEQ ID NO: 596164 - DNA, 499 bp, Homo sapiens
  misc_feature: HIJSMM301EQESI.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcgccaagggaccaaggagcaaatacaaacgaactagtggctgcaccatctgtcttcatcttcccgccact

SEQ ID NO: 596165 - DNA, 512 bp, Homo sapiens
  misc_feature: HIJSMM301ERMPY.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactagtggctgcaccatctgtcttcactcttcccgtccat

SEQ ID NO: 596166 - DNA, 510 bp, Homo sapiens
  misc_feature: HIJSMM301ASPNB.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctcgtt

SEQ ID NO: 596167 - DNA, 479 bp, Homo sapiens; identical to SEQ ID NO: 535188
  misc_feature: HIJSMM301BX00I.10.74.G08.1.454.light.4.raw

SEQ ID NO: 596168 - DNA, 494 bp, Homo sapiens; identical to SEQ ID NO: 534994
  misc_feature: HIJSMM301CBNFR.27.78.H01.1.454.light.4.raw

SEQ ID NO: 596169 - DNA, 517 bp, Homo sapiens
  misc_feature: HIJSMM301B78MX.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtgctgcaccatctgtcttcatcttccccg

SEQ ID NO: 596170 - DNA, 489 bp, Homo sapiens; identical to SEQ ID NO: 535139
  misc_feature: HIJSMM301ENEMH.14.55.E11.1.454.light.4.raw

SEQ ID NO: 596171 - DNA, 476 bp, Homo sapiens; identical to SEQ ID NO: 538026
  misc_feature: HIJSMM301EOJBS.13.76.G10.1.454.light.4.raw

SEQ ID NO: 596172 - DNA, 510 bp, Homo sapiens; identical to SEQ ID NO: 538614
  misc_feature: HIJSMM301ETU1W.19.59.F04.1.454.light.4.raw

SEQ ID NO: 596173 - DNA, 441 bp, Homo sapiens; identical to SEQ ID NO: 535074
  misc_feature: HIJSMM301EKZOH.11.3.A03.1.454.light.4.raw

SEQ ID NO: 596174 - DNA, 503 bp, Homo sapiens
  misc_feature: HIJSMM301CX06L.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctggaccaaagtggatatcaaacgaactgtggctgcaccatctgtctt

SEQ ID NO: 596175 - DNA, 474 bp, Homo sapiens
  misc_feature: HIJSMM301B7S58.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggcctggactgaagtgcatatgaagagaactgtggctgcaa

SEQ ID NO: 596176 - DNA, 462 bp, Homo sapiens
  misc_feature: HIJSMM301E0302.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctccggtcactctgttcccacccctcctcgtatctctcg

SEQ ID NO: 596177 - DNA, 496 bp, Homo sapiens
  misc_feature: HIJSMM301C509B.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgcctcctc

SEQ ID NO: 596178 - DNA, 521 bp, Homo sapiens; identical to SEQ ID NO: 539470
  misc_feature: HIJSMM301AJ27A.27.23.C01.1.454.light.4.raw

SEQ ID NO: 596179 - DNA, 495 bp, Homo sapiens; identical to SEQ ID NO: 535007
  misc_feature: HIJSMM301DG62R.22.5.A05.1.454.light.4.raw

SEQ ID NO: 596180 - DNA, 484 bp, Homo sapiens
  misc_feature: HIJSMM301BUBPQ.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgagggatgttattgggctctattattgcatgcaagacaacacacgtggccgtactacttttggccgacgggaccaagctggagatcaatcgaa

SEQ ID NO: 596181 - DNA, 507 bp, Homo sapiens
  misc_feature: HIJSMM301C8AJY.13.53.E09.1.454.light.4.raw
  modified_base (428)..(428): a, c, t, g, unknown or other
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttntcccccggacgtcgtcacggacaacggtcggaaagtacaagacgaacctagtggctggcaccaactctcgtcttctatt

SEQ ID NO: 596182 - DNA, 523 bp, Homo sapiens
  misc_feature: HIJSMM301E3YXH.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccgactttcggtcccgtcgggaccgaacggtaggaggagtacaaacgaaacctagtggctgcgaccatcctgttcttctat

SEQ ID NO: 596183 - DNA, 520 bp, Homo sapiens
  misc_feature: HIJSMM301BOSUA.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgtttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccgccctcctcgagtacg

SEQ ID NO: 596184 - DNA, 445 bp, Homo sapiens; identical to SEQ ID NO: 541697
  misc_feature: HIJSMM301BXSKA.18.9.A09.1.454.light.4.raw

SEQ ID NO: 596185 - DNA, 492 bp, Homo sapiens; identical to SEQ ID NO: 554344
  misc_feature: HIJSMM301AUV29.10.17.B06.1.454.light.4.raw

SEQ ID NO: 596186 - DNA, 489 bp, Homo sapiens; identical to SEQ ID NO: 536663
  misc_feature: HIJSMM301DDQRW.16.72.G06.1.454.light.4.raw

SEQ ID NO: 596187 - DNA, 512 bp, Homo sapiens
  misc_feature: HIJSMM301BUP4C.21.87.H10.1.454.light.4.raw
  modified_base (316)..(316): a, c, t, g, unknown or other
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcgggancgaccctcacatgtttccagtcgattctctgcatccaagtctggcaacacggcctttctgacaatctctcaactccaggctgaagacgaggctatttattactgctcctcatacgcaggtggcactatttttcttggtttttggcggcgggacccagatgactgtcctcagtcagcccaaggctcgccccctcggt

SEQ ID NO: 596188 - DNA, 506 bp, Homo sapiens
  misc_feature: HIJSMM301C55QL.7.21.B10.1.454.light.4.raw
cgtgtctctacacgaccggtgctcgatttagtgtcgtcgcaagagaggaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 596189 - DNA, 415 bp, Homo sapiens; identical to SEQ ID NO: 536118
  misc_feature: HIJSMM301CWIVO.18.78.H01.1.454.light.4.raw

SEQ ID NO: 596190 - DNA, 506 bp, Homo sapiens
  misc_feature: HIJSMM301BT2RI.53.62.F07.1.454.light.4.raw
cgcgtatacacacgaccggtgctcgatttagtagtcgcataaagggaaagggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccaacagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaagctgaccgtcctaggtcagcccaaggctgccccctcggtcactctgttcccg

SEQ ID NO: 596191 - DNA, 486 bp, Homo sapiens; identical to SEQ ID NO: 535043
  misc_feature: HIJSMM301AG8MV.46.35.D02.1.454.light.4.raw

SEQ ID NO: 596192 - DNA, 497 bp, Homo sapiens
  misc_feature: HIJSMM301E3RZW.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacacagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 596193 - DNA, 463 bp, Homo sapiens; identical to SEQ ID NO: 535062
  misc_feature: HIJSMM301A6O8U.11.73.G07.1.454.light.4.raw

SEQ ID NO: 596194 - DNA, 494 bp, Homo sapiens; identical to SEQ ID NO: 534994
  misc_feature: HIJSMM301CNMXM.27.78.H01.1.454.light.4.raw

SEQ ID NO: 596195 - DNA, 509 bp, Homo sapiens
  misc_feature: HIJSMM301CXQRU.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtctaggtcagcccaaggctgccccctcggtcactctgttccccg

SEQ ID NO: 596196 - DNA, 488 bp, Homo sapiens; identical to SEQ ID NO: 539884
  misc_feature: HIJSMM301EPZKP.7.85.H08.1.454.light.4.raw

SEQ ID NO: 596197 - DNA, 481 bp, Homo sapiens; identical to SEQ ID NO: 535993
  misc_feature: HIJSMM301C40FP.21.25.C03.1.454.light.4.raw

SEQ ID NO: 596198 - DNA, 484 bp, Homo sapiens; identical to SEQ ID NO: 535240
  misc_feature: HIJSMM301EHAZK.47.60.F05.1.454.light.4.raw

SEQ ID NO: 596199 - DNA, 487 bp, Homo sapiens; identical to SEQ ID NO: 549564
  misc_feature: HIJSMM301EAXI8.15.28.C06.1.454.light.4.raw

SEQ ID NO: 596200 - DNA, 507 bp, Homo sapiens; identical to SEQ ID NO: 544788
  misc_feature: HIJSMM301AHPFT.16.46.E02.1.454.light.4.raw

SEQ ID NO: 596201 - DNA, 492 bp, Homo sapiens; identical to SEQ ID NO: 535426
  misc_feature: HIJSMM301C7M8F.47.78.H01.1.454.light.4.raw

SEQ ID NO: 596202 - DNA, 519 bp, Homo sapiens
  misc_feature: HIJSMM301B7CZ8.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggcctgccccctcggtcactctgttcccaccctcctcgagt

SEQ ID NO: 596203 - DNA, 494 bp, Homo sapiens
  misc_feature: HIJSMM301DNMOD.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccgaaagtggagatcaacgaactgtggctgcaccatctgtctt

SEQ ID NO: 596204 - DNA, 503 bp, Homo sapiens
  misc_feature: HIJSMM301AJP4C.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccacctaattacgttcgaggacggactagtacaatactacacgtacgacgtggtcgtctcgaccaactcttcg

SEQ ID NO: 596205 - DNA, 488 bp, Homo sapiens; identical to SEQ ID NO: 536861
  misc_feature: HIJSMM301EDL2C.12.88.H11.1.454.light.4.raw

SEQ ID NO: 596206 - DNA, 496 bp, Homo sapiens
  misc_feature: HIJSMM301AHX8I.11.10.A10.1.454.light.4.raw
  modified_base (189)..(189): a, c, t, g, unknown or other
  modified_base (445)..(445): a, c, t, g, unknown or other
  modified_base (471)..(471): a, c, t, g, unknown or other
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaangccaccctctcctgcagggtccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttgccgacggacgaacgnggaagtcaaacgaactagtggctgcnccactctgtcttctactcttcccgt

SEQ ID NO: 596207 - DNA, 484 bp, Homo sapiens; identical to SEQ ID NO: 535441
  misc_feature: HIJSMM301D01DS.26.60.F05.1.454.light.4.raw

SEQ ID NO: 596208 - DNA, 506 bp, Homo sapiens; identical to SEQ ID NO: 554070
  misc_feature: HIJSMM301D46OW.15.5.A05.1.454.light.4.raw

SEQ ID NO: 596209 - DNA, 504 bp, Homo sapiens
  misc_feature: HIJSMM301BB9XE.27.78.H01.1.454.light.4.raw
agcgtcgtctcacgaccggtgctcgatttagtgtgagtagtttgggtttggggatcttaaaaggaggttctttctctgggatgtggcatgagcaaaactgacaagtcaaggcaggaagatgttcgccatcacaactcattgggtttctgctgctctgggttccagcctccaggggtgaaattgtgctgactcagtctccagactttcagtctgtgactccaaaggagaaagtcaccatcacctgaccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcaccttcggccaagggacacgactggagattaaacg

SEQ ID NO: 596210 - DNA, 494 bp, Homo sapiens; identical to SEQ ID NO: 534992
  misc_feature: HIJSMM301A7LED.9.1.A01.1.454.light.4.raw

SEQ ID NO: 596211 - DNA, 504 bp, Homo sapiens
  misc_feature: HIJSMM301EVGT9.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgaccatctctgggctccaggctgaggacgaggctgattatactgcaactcaacttacaacgaccgacacttgcgtattcggcggcgggaccaagctgaccgtcctaggtcagcccaaaggctgccccctcggtcactcctgtttcccacccgtcctcactactcacaa

SEQ ID NO: 596212 - DNA, 486 bp, Homo sapiens; identical to SEQ ID NO: 543923
  misc_feature: HIJSMM301AG9GL.3.88.H11.1.454.light.4.raw

SEQ ID NO: 596213 - DNA, 493 bp, Homo sapiens; identical to SEQ ID NO: 535548
  misc_feature: HIJSMM301BNMXW.51.81.H04.1.454.light.4.raw

SEQ ID NO: 596214 - DNA, 485 bp, Homo sapiens; identical to SEQ ID NO: 543441
  misc_feature: HIJSMM301DOROL.26.55.E11.1.454.light.4.raw

SEQ ID NO: 596215 - DNA, 484 bp, Homo sapiens; identical to SEQ ID NO: 535400
  misc_feature: HIJSMM301DV32M.46.26.C04.1.454.light.4.raw

SEQ ID NO: 596216 - DNA, 521 bp, Homo sapiens
  misc_feature: HIJSMM301BQQ8O.27.23.C01.1.454.light.4.raw
  modified_base (500)..(500): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccccncggtcactctgttcccaccct

SEQ ID NO: 596217 - DNA, 485 bp, Homo sapiens; identical to SEQ ID NO: 535822
  misc_feature: HIJSMM301A63LJ.14.53.E09.1.454.light.4.raw

SEQ ID NO: 596218 - DNA, 504 bp, Homo sapiens
  misc_feature: HIJSMM301EDD3O.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctccggtcactctgttcccccg

SEQ ID NO: 596219 - DNA, 494 bp, Homo sapiens; identical to SEQ ID NO: 534992
  misc_feature: HIJSMM301CV7BF.9.1.A01.1.454.light.4.raw

SEQ ID NO: 596220 - DNA, 514 bp, Homo sapiens
  misc_feature: HIJSMM301CJQ12.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgactttactattgtcaacagagttaccttctcccccggacgttcgtccacggaccgaacggtacggaagtacaagcgaactacgtggtcgtgcgaccactctgtcttcactcttcccgt

SEQ ID NO: 596221 - DNA, 507 bp, Homo sapiens
  misc_feature: HIJSMM301CO4F0.49.52.E08.1.454.light.4.raw
agtcgagagacacgaccggtgctcgatttagtcgagctctcccgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggcctgccccctcggtcta

SEQ ID NO: 596222 - DNA, 500 bp, Homo sapiens
  misc_feature: HIJSMM301CAMGA.15.1.A01.1.454.light.4.raw
tctacgtagccacgaccggtgctcgatttagacgtctcatcaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccacccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagccaaggctgccccctcggtcact

SEQ ID NO: 596223 - DNA, 496 bp, Homo sapiens
  misc_feature: HIJSMM301B5J4D.52.51.E07.1.454.light.4.raw
cgcagtacgacacgaccggtgctcgatttagcatactctacaacacacaaaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgccccaccgataagaactacttagcttggtatcagcacaaaccaggacaccctcccaaactcctcatttcctgggcatctacccgggaatccggggtccctgaccgattcagtggcagcgggtctgagacggatttcactctcaccatcagcagcctgcaggctgaagatgtggcagtgtattactgtcagcagtatgctggtactccctacacttttggccaggggaccaaggtggagatcaacgaactgtggctgcaccatctgtcttcatcttccgt

SEQ ID NO: 596224 - DNA, 488 bp, Homo sapiens
  misc_feature: HIJSMM301BDGVY.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctggactattactgttcagcatgggacggcagcctcagtgaatgggtgttcggcggagggaccaaactgtccgtcctaggtcagccccg

SEQ ID NO: 596225 - DNA, 506 bp, Homo sapiens; identical to SEQ ID NO: 543046
  misc_feature: HIJSMM301BIZ13.53.71.G05.1.454.light.4.raw

SEQ ID NO: 596226 - DNA, 489 bp, Homo sapiens; identical to SEQ ID NO: 535139
  misc_feature: HIJSMM301BS02O.14.55.E11.1.454.light.4.raw

SEQ ID NO: 596227 - DNA, 499 bp, Homo sapiens
  misc_feature: HIJSMM301CBS57.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgaagatttgcagtttattactgtcagcagtatgatacctggcctccgtacacttttggccgggggaccaagctggaaatcaagcgaactgtggctgcaccatctgtcttcatcttccccg

SEQ ID NO: 596228 - DNA, 487 bp, Homo sapiens; identical to SEQ ID NO: 554782
  misc_feature: HIJSMM301DA8N0.46.35.D02.1.454.light.4.raw

SEQ ID NO: 596229 - DNA, 504 bp, Homo sapiens; identical to SEQ ID NO: 536385
  misc_feature: HIJSMM301ESF58.27.78.H01.1.454.light.4.raw

SEQ ID NO: 596230 - DNA, 496 bp, Homo sapiens; identical to SEQ ID NO: 549958
  misc_feature: HIJSMM301AP4E4.10.25.C03.1.454.light.4.raw

SEQ ID NO: 596231 - DNA, 481 bp, Homo sapiens; identical to SEQ ID NO: 535677
  misc_feature: HIJSMM301A0TO1.5.39.D06.1.454.light.4.raw

SEQ ID NO: 596232 - DNA, 493 bp, Homo sapiens
  misc_feature: HIJSMM301EGJMX.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgcccctcggtcactctgttcccgccctcctcgctacgtaga

SEQ ID NO: 596233 - DNA, 519 bp, Homo sapiens
  misc_feature: HIJSMM301EMX05.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccgaacgggaccgaacggtaggaaagtacaagacgaacctagtggcgtggcaccaatctgtcttctactcttcccgt

SEQ ID NO: 596234 - DNA, 443 bp, Homo sapiens
  misc_feature: HIJSMM301B46SJ.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgcctcctccactactatg

SEQ ID NO: 596235 - DNA, 499 bp, Homo sapiens
  misc_feature: HIJSMM301CAND0.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctggaggacgaggctgatttattactgcagctcatatacaagcagcagcactcaagtcttcggaactgggaccaaggtcaccgtctaggtcagcccaaggccaa

SEQ ID NO: 596236 - DNA, 521 bp, Homo sapiens; identical to SEQ ID NO: 536990
  misc_feature: HIJSMM301CSZTS.27.23.C01.1.454.light.4.raw
  modified_base (517)..(517): a, c, t, g, unknown or other

SEQ ID NO: 596237 - DNA, 494 bp, Homo sapiens
  misc_feature: HIJSMM301EBYWO.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcaccttttggcctagggggaccaaactggatatcagacgaactgtggctgcaa

SEQ ID NO: 596238 - DNA, 444 bp, Homo sapiens; identical to SEQ ID NO: 535027
  misc_feature: HIJSMM301DE8Q0.8.73.G07.1.454.light.4.raw

SEQ ID NO: 596239 - DNA, 488 bp, Homo sapiens
  misc_feature: HIJSMM301BW7FP.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacaggagttcactctcaccatcagcagcctgcagtctgaggattttgctagtttattactgtcagcattacaataactggcctcggctcactttcggcggagggaccaaggtggagatcaaacgaactgtggctgcaccat

SEQ ID NO: 596240 - DNA, 496 bp, Homo sapiens
  misc_feature: HIJSMM301BVYXF.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgtcgtcaggaccgaaggtaggacgagtcaacgaaactacgtggcgtgcaccaatcctgtctt

SEQ ID NO: 596241 - DNA, 443 bp, Homo sapiens
  misc_feature: HIJSMM301DFW6U.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctcgtatagacg

SEQ ID NO: 596242 - DNA, 515 bp, Homo sapiens
  misc_feature: HIJSMM301CTA3Q.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccatgttgcaccgcaaagcgggacccagaccctggagcctcagttggaagcagccgatccagcctgcggagcctgtggggcaggtcagcccaaggcctgccccctcggtcactctgttcccaccctcctccacg

SEQ ID NO: 596243 - DNA, 512 bp, Homo sapiens
  misc_feature: HIJSMM301A6BDP.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttccccgt

SEQ ID NO: 596244 - DNA, 447 bp, Homo sapiens; identical to SEQ ID NO: 535020
  misc_feature: HIJSMM301EAO3I.18.9.A09.1.454.light.4.raw

SEQ ID NO: 596245 - DNA, 509 bp, Homo sapiens
  misc_feature: HIJSMM301BIPNW.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaaggccaaccccactgtcact

SEQ ID NO: 596246 - DNA, 506 bp, Homo sapiens
  misc_feature: HIJSMM301BL55R.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccaaggtggaaatacaaacgaactagtggctgcaccatctgtcttcatcttccccg

SEQ ID NO: 596247 - DNA, 495 bp, Homo sapiens
  misc_feature: HIJSMM301EOPEQ.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgctagtttattactgtcagcagcgtagcaactggcctctcaccttcggcggacgggaccaagggtggagatacaaacgaactgtggctgcaccatctgtt

SEQ ID NO: 596248 - DNA, 503 bp, Homo sapiens
  misc_feature: HIJSMM301B9MLV.48.30.C08.1.454.light.4.raw
agtatacatacacgaccggtgctcgatttagtctgacgtcaaagggaaaggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagtagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatt

SEQ ID NO: 596249 - DNA, 506 bp, Homo sapiens; identical to SEQ ID NO: 567467
  misc_feature: HIJSMM301EOR8J.7.71.G05.1.454.light.4.raw

SEQ ID NO: 596250 - DNA, 489 bp, Homo sapiens; identical to SEQ ID NO: 535139
  misc_feature: HIJSMM301AEMYG.14.55.E11.1.454.light.4.raw

SEQ ID NO: 596251 - DNA, 476 bp, Homo sapiens
  misc_feature: HIJSMM301DGELE.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcacc

SEQ ID NO: 596252 - DNA, 486 bp, Homo sapiens; identical to SEQ ID NO: 535043
  misc_feature: HIJSMM301AWGMO.46.35.D02.1.454.light.4.raw

SEQ ID NO: 596253 - DNA, 468 bp, Homo sapiens
  misc_feature: HIJSMM301DKXDM.49.8.A08.1.454.light.4.raw
agtcgagagacacgaccggtgctcgatttagcatactctacaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaactgtggctgca

SEQ ID NO: 596254 - DNA, 482 bp, Homo sapiens
  misc_feature: HIJSMM301B3KMD.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtccta

SEQ ID NO: 596255 - DNA, 486 bp, Homo sapiens; identical to SEQ ID NO: 535290
  misc_feature: HIJSMM301EGH0L.3.12.B01.1.454.light.4.raw

SEQ ID NO: 596256 - DNA, 510 bp, Homo sapiens
  misc_feature: HIJSMM301BOQE8.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagccaaggctgccccctcggtcactctgttcccta

SEQ ID NO: 596257 - DNA, 506 bp, Homo sapiens
  misc_feature: HIJSMM301ECMB3.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccaaggtggacctcaaacgaactgtggctgcaccatctgtcttcatcttcccgcc

SEQ ID NO: 596258 - DNA, 457 bp, Homo sapiens; identical to SEQ ID NO: 541372
  misc_feature: HIJSMM301A8RP2.41.57.F02.1.454.light.4.raw

SEQ ID NO: 596259 - DNA, 493 bp, Homo sapiens
  misc_feature: HIJSMM301C3HFP.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagatttgcagtttattactgtcagcagtatggtacttcacaaaccttcggccaggggacacgactggagattaagcgaactgtggctgcaccatctgtctt

SEQ ID NO: 596260 - DNA, 489 bp, Homo sapiens; identical to SEQ ID NO: 538487
  misc_feature: HIJSMM301CJ8E2.16.68.G02.1.454.light.4.raw

SEQ ID NO: 596261 - DNA, 440 bp, Homo sapiens; identical to SEQ ID NO: 594354
  misc_feature: HIJSMM301CBT0N.41.9.A09.1.454.light.4.raw

SEQ ID NO: 596262 - DNA, 498 bp, Homo sapiens
  misc_feature: HIJSMM301D8KTG.43.42.D09.1.454.light.4.raw
tgtgagtagtcacgaccggtgctcgatttagacacatacgcagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccgaaggtggagatcaaacgaaactgtggctgcaccatctgtcttctat

SEQ ID NO: 596263 - DNA, 495 bp, Homo sapiens
  misc_feature: HIJSMM301CGNMA.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctggcaccatctgtctt

SEQ ID NO: 596264 - DNA, 497 bp, Homo sapiens
  misc_feature: HIJSMM301CI874.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgcggtttattactgtcagcagtataataactggcctccacggtacacttttggccaggggaccaagctggagatcaaacgaactgtggctgcaccatctgt

SEQ ID NO: 596265 - DNA, 490 bp, Homo sapiens
  misc_feature: HIJSMM301DR4R3.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagatttgcaacttatttttgtcaacaggctaacactttccccctcactttcggcggagggaccaaggtggagatcaagcgaactgtggctgcaccatctgtctt

SEQ ID NO: 596266 - DNA, 501 bp, Homo sapiens
  misc_feature: HIJSMM301BVVK9.5.86.H09.1.454.light.4.raw
atcagacacgcacgaccggtgctcgatttagtgctatagacttgggtttgggggctggggtctcaggaggcagtgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctc

SEQ ID NO: 596267 - DNA, 504 bp, Homo sapiens; identical to SEQ ID NO: 535128
  misc_feature: HIJSMM301ANLP9.19.85.H08.1.454.light.4.raw

SEQ ID NO: 596268 - DNA, 490 bp, Homo sapiens; identical to SEQ ID NO: 543909
  misc_feature: HIJSMM301EURXG.14.55.E11.1.454.light.4.raw

SEQ ID NO: 596269 - DNA, 529 bp, Homo sapiens
  misc_feature: HIJSMM301BN45E.48.17.B06.1.454.light.4.raw
agtatacatacacgaccggtgctcgatttagtcgatagtgaaggggggggtcgacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgtattttcggcggagggaaccaagctcgacccgtcctaccgtcacgcccaacggctcgccccctcggtcactctcgttccccaccctt

SEQ ID NO: 596270 - DNA, 479 bp, Homo sapiens
  misc_feature: HIJSMM301AXI0R.3.2.A02.1.454.light.4.raw
agacgcactccacgaccggtgctcgatttagactcatctacagggggtgcaggagtcagtctcagtcaggacacagcatggacatgagggtccccgctcagctcctggggctcctgctactctggctccgaggtgccagatgtgacatccagatgacccagtctccttcctccctgtctgcatctgtgggagacagagtcaccctcacttgccggccaagtcacagcattagcatctatttaaattggtatcaacagaagccagggaaagcccctaacctcctgatctatactgcatccagtttgcaaagtggagtcccatcaaggttcagtggcagtggatctgggacagagttcactctcaccatcagcagtctgcaacctgaagattttgcaacttactactgtcaacagagttacagtatccctccaaccttcggcggagggaccaaggtggagatcaaacgaactgtggctgca

SEQ ID NO: 596271 - DNA, 488 bp, Homo sapiens
  misc_feature: HIJSMM301DCAPM.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaaactgtggctgcaccatctgt

SEQ ID NO: 596272 - DNA, 486 bp, Homo sapiens; identical to SEQ ID NO: 535043
  misc_feature: HIJSMM301D70M0.46.35.D02.1.454.light.4.raw

SEQ ID NO: 596273 - DNA, 504 bp, Homo sapiens
  misc_feature: HIJSMM301ASNIF.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgagactggccgttcactttcggcggagggaccaaggtggacctcaaacgaactgtggctgcaccatctgtcttcatcttcccgcc

SEQ ID NO: 596274 - DNA, 494 bp, Homo sapiens; identical to SEQ ID NO: 534994
  misc_feature: HIJSMM301AK387.27.78.H01.1.454.light.4.raw

SEQ ID NO: 596275 - DNA, 507 bp, Homo sapiens; identical to SEQ ID NO: 567211
  misc_feature: HIJSMM301AU6KV.7.71.G05.1.454.light.4.raw

SEQ ID NO: 596276 - DNA, 505 bp, Homo sapiens
  misc_feature: HIJSMM301BK9C9.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaagttgaccgtcctaagtcagcccaaggctgccccctcggtcactctcg

SEQ ID NO: 596277 - DNA, 507 bp, Homo sapiens; identical to SEQ ID NO: 561702
  misc_feature: HIJSMM301DOWAF.5.24.C02.1.454.light.4.raw

SEQ ID NO: 596278 - DNA, 485 bp, Homo sapiens
  misc_feature: HIJSMM301B9QBL.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctggattattactgccactcctatgacaacagcctgagtattggctgtcggcggcggaccagttacg

SEQ ID NO: 596279 - DNA, 496 bp, Homo sapiens
  misc_feature: HIJSMM301AR2CR.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcgggcggagggacgaagctgaccgtcctgagtcagcccaaggctgccccctggtcactc

SEQ ID NO: 596280 - DNA, 507 bp, Homo sapiens
  misc_feature: HIJSMM301DFDYJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccaagggtggaaatacaaacgaactagtggctgcaccatctgtcttcatcttccccg

SEQ ID NO: 596281 - DNA, 506 bp, Homo sapiens; identical to SEQ ID NO: 541287
  misc_feature: HIJSMM301AZ8XC.19.78.H01.1.454.light.4.raw

SEQ ID NO: 596282 - DNA, 501 bp, Homo sapiens; identical to SEQ ID NO: 550407
  misc_feature: HIJSMM301CQHWB.4.39.D06.1.454.light.4.raw

SEQ ID NO: 596283 - DNA, 489 bp, Homo sapiens; identical to SEQ ID NO: 575126
  misc_feature: HIJSMM301ARF00.26.37.D04.1.454.light.4.raw

SEQ ID NO: 596284 - DNA, 463 bp, Homo sapiens; identical to SEQ ID NO: 535062
  misc_feature: HIJSMM301AOGWL.11.73.G07.1.454.light.4.raw

SEQ ID NO: 596285 - DNA, 444 bp, Homo sapiens
  misc_feature: HIJSMM301AQPOI.18.9.A09.1.454.light.4.raw
tacgagtatgcacgaccggtgctcgatttagcgagacgcgcagggtcctgggcccagtctgtgctgacgcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcctaccctcctccatactcgta

SEQ ID NO: 596286 - DNA, 509 bp, Homo sapiens; identical to SEQ ID NO: 536047
  misc_feature: HIJSMM301D1SYK.17.33.C11.1.454.light.4.raw

SEQ ID NO: 596287 - DNA, 484 bp, Homo sapiens; identical to SEQ ID NO: 535400
  misc_feature: HIJSMM301A50E8.46.26.C04.1.454.light.4.raw

SEQ ID NO: 596288 - DNA, 511 bp, Homo sapiens
  misc_feature: HIJSMM301AIL6G.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacggcaacatgggatgacaaatctgagcgggttgggtggttcggcggaggggaccaaaactgaccgtccctaggtcgagcccaac

SEQ ID NO: 596289 - DNA, 496 bp, Homo sapiens
  misc_feature: HIJSMM301CSJ59.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtccagggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtccaggtcagcccaagg

SEQ ID NO: 596290 - DNA, 514 bp, Homo sapiens
  misc_feature: HIJSMM301EOIC7.14.33.C11.1.454.light.4.raw
cgtctagtaccacgaccggtgctcgatttagagtgagctcgttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctcg

SEQ ID NO: 596291 - DNA, 496 bp, Homo sapiens
  misc_feature: HIJSMM301DEINT.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcaggtgggtctggaacagagttcactctcaccatcagcggcctgcagtctgaagattttgctagtttattactgtcagcagtataatgacttgggttttattctactttcggccctgggaccaaagtggatttcagacgaactgtggctgcaccatctgtcttcta

SEQ ID NO: 596292 - DNA, 495 bp, Homo sapiens
  misc_feature: HIJSMM301DAGMT.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggacccgaaggtggagatcaagcgaactgtggctgcgaccatctgtcttcatcttcccgt

SEQ ID NO: 596293 - DNA, 500 bp, Homo sapiens; identical to SEQ ID NO: 546095
  misc_feature: HIJSMM301AF2B7.52.78.H01.1.454.light.4.raw

SEQ ID NO: 596294 - DNA, 499 bp, Homo sapiens; identical to SEQ ID NO: 541446
  misc_feature: HIJSMM301D3UHD.43.34.D01.1.454.light.4.raw

SEQ ID NO: 596295 - DNA, 496 bp, Homo sapiens
  misc_feature: HIJSMM301BOALF.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtgggctgcaccatctgtctt

SEQ ID NO: 596296 - DNA, 523 bp, Homo sapiens
  misc_feature: HIJSMM301ES97S.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccgaacgggaccgaacggtaggaaagtacaaaacgaaacctaggtggtcgtgcgaccaatctgtcttcctatcttcccccg

SEQ ID NO: 596297 - DNA, 503 bp, Homo sapiens
  misc_feature: HIJSMM301AHOFL.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaagtggatatcaaacgaactagtggctgcaccatctgtcttcatt

SEQ ID NO: 596298 - DNA, 510 bp, Homo sapiens
  misc_feature: HIJSMM301C4YWC.8.42.D09.1.454.light.4.raw
ctcgcgtgtccacgaccggtgctcgatttagacacatacgcagggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccctcc

SEQ ID NO: 596299 - DNA, 506 bp, Homo sapiens; identical to SEQ ID NO: 563474
  misc_feature: HIJSMM301AIHZ6.10.27.C05.1.454.light.4.raw

SEQ ID NO: 596300 - DNA, 444 bp, Homo sapiens; identical to SEQ ID NO: 535856
  misc_feature: HIJSMM301B8HSP.9.9.A09.1.454.light.4.raw

SEQ ID NO: 596301 - DNA, 513 bp, Homo sapiens; identical to SEQ ID NO: 555055
  misc_feature: HIJSMM301CS4LO.15.76.G10.1.454.light.4.raw

SEQ ID NO: 596302 - DNA, 495 bp, Homo sapiens; identical to SEQ ID NO: 552120
  misc_feature: HIJSMM301EIIGI.51.26.C04.1.454.light.4.raw

SEQ ID NO: 596303 - DNA, 493 bp, Homo sapiens
  misc_feature: HIJSMM301DH2J3.16.68.G02.1.454.light.4.raw
tgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggtagggaccaaaggtggaggtcaaacgaactgtggctgcaccatctgtctt

SEQ ID NO: 596304 - DNA, 496 bp, Homo sapiens
  misc_feature: HIJSMM301ET4TU.51.39.D06.1.454.light.4.raw
cgatcgtatacacgaccggtgctcgatttagtgacatctcgcagttctttggggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagacccc

SEQ ID NO: 596305 - DNA, 473 bp, Homo sapiens
  misc_feature: HIJSMM301ANE6D.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgtattttgctcctccgagtgccacttttggcggggggaccaaggtggacatacaaacgaa

SEQ ID NO: 596306 - DNA, 490 bp, Homo sapiens; identical to SEQ ID NO: 541974
  misc_feature: HIJSMM301BK0GJ.22.65.F10.1.454.light.4.raw

SEQ ID NO: 596307 - DNA, 488 bp, Homo sapiens; identical to SEQ ID NO: 536861
  misc_feature: HIJSMM301C4CTC.12.88.H11.1.454.light.4.raw

SEQ ID NO: 596308 - DNA, 488 bp, Homo sapiens; identical to SEQ ID NO: 537527
  misc_feature: HIJSMM301C1UW1.26.78.H01.1.454.light.4.raw

SEQ ID NO: 596309 - DNA, 444 bp, Homo sapiens
  misc_feature: HIJSMM301BV8TD.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactttgttcctaccctcctcgtactagacg

SEQ ID NO: 596310 - DNA, 482 bp, Homo sapiens; identical to SEQ ID NO: 569533
  misc_feature: HIJSMM301B9MKB.4.1.A01.1.454.light.4.raw

SEQ ID NO: 596311 - DNA, 497 bp, Homo sapiens
  misc_feature: HIJSMM301B4PNK.3.36.D03.1.454.light.4.raw
  modified_base (199)..(199): a, c, t, g, unknown or other
agacgcactccacgaccggtgctcgatttagctgcgtcacgagtctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcggggccagtcagagtgttcccagcaactatatagcctggtaccagcacaaagttggcctggcgcccaggctcctcactctatgatacattcaccagggccactggcatcccggacagggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcaccatctgtctt

SEQ ID NO: 596312 - DNA, 490 bp, Homo sapiens
  misc_feature: HIJSMM301BPGYY.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccgaaggaccgaaggtggaactacaaacgaaa

SEQ ID NO: 596313 - DNA, 511 bp, Homo sapiens
  misc_feature: HIJSMM301ELDWQ.15.86.H09.1.454.light.4.raw
  modified_base (496)..(496): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccnccctcctcgctacgt

SEQ ID NO: 596314 - DNA, 490 bp, Homo sapiens; identical to SEQ ID NO: 542820
  misc_feature: HIJSMM301DPL9R.11.12.B01.1.454.light.4.raw

SEQ ID NO: 596315 - DNA, 487 bp, Homo sapiens; identical to SEQ ID NO: 559158
  misc_feature: HIJSMM301DLW64.40.83.H06.1.454.light.4.raw

SEQ ID NO: 596316 - DNA, 489 bp, Homo sapiens; identical to SEQ ID NO: 557621
  misc_feature: HIJSMM301CBMTC.13.87.H10.1.454.light.4.raw

SEQ ID NO: 596317 - DNA, 497 bp, Homo sapiens; identical to SEQ ID NO: 575888
  misc_feature: HIJSMM301EG181.7.59.F04.1.454.light.4.raw

SEQ ID NO: 596318 - DNA, 523 bp, Homo sapiens
  misc_feature: HIJSMM301BL4OQ.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtcctaggtcagcccaaggctgccccctcggtcactctgttcccgccct

SEQ ID NO: 596319 - DNA, 494 bp, Homo sapiens; identical to SEQ ID NO: 534992
  misc_feature: HIJSMM301D1K5S.9.1.A01.1.454.light.4.raw

SEQ ID NO: 596320 - DNA, 479 bp, Homo sapiens; identical to SEQ ID NO: 535118
  misc_feature: HIJSMM301C4JSI.13.59.F04.1.454.light.4.raw

SEQ ID NO: 596321 - DNA, 500 bp, Homo sapiens; identical to SEQ ID NO: 535310
  misc_feature: HIJSMM301AZKZO.47.66.F11.1.454.light.4.raw

SEQ ID NO: 596322 - DNA, 488 bp, Homo sapiens; identical to SEQ ID NO: 535990
  misc_feature: HIJSMM301DRY3M.11.28.C06.1.454.light.4.raw

SEQ ID NO: 596323 - DNA, 512 bp, Homo sapiens
  misc_feature: HIJSMM301CN0XC.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccgaagggaccgaaggtaggaaagtacaaacgaactagtggctgcaccatctgtcttctatcttccccg

SEQ ID NO: 596324 - DNA, 515 bp, Homo sapiens
  misc_feature: HIJSMM301DBJ9M.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggaggggaccaaactgaccgtcctaggtcagcccaaggctgccccctcggtcactctcg

SEQ ID NO: 596325 - DNA, 495 bp, Homo sapiens
  misc_feature: HIJSMM301CJMGR.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggcctaggggactaagctggagatcaaacgaactgtggctgcaccatctgtcttcatcttcccg

SEQ ID NO: 596326 - DNA, 509 bp, Homo sapiens; identical to SEQ ID NO: 535670
  misc_feature: HIJSMM301ARZRB.47.23.C01.1.454.light.4.raw

SEQ ID NO: 596327 - DNA, 484 bp, Homo sapiens; identical to SEQ ID NO: 535240
  misc_feature: HIJSMM301BW1WL.47.60.F05.1.454.light.4.raw

SEQ ID NO: 596328 - DNA, 461 bp, Homo sapiens
  misc_feature: HIJSMM301BP9RI.51.1.A01.1.454.light.4.raw
cgatcgtatacacgaccggtgctcgatttagacgtctcatcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccgaaggtgggatcaaacgaa

SEQ ID NO: 596329 - DNA, 521 bp, Homo sapiens; identical to SEQ ID NO: 538715
  misc_feature: HIJSMM301AP7O2.27.23.C01.1.454.light.4.raw

SEQ ID NO: 596330 - DNA, 447 bp, Homo sapiens; identical to SEQ ID NO: 535201
  misc_feature: HIJSMM301ESPLS.18.9.A09.1.454.light.4.raw

SEQ ID NO: 596331 - DNA, 496 bp, Homo sapiens; identical to SEQ ID NO: 573952
  misc_feature: HIJSMM301B2Q5H.16.78.H01.1.454.light.4.raw

SEQ ID NO: 596332 - DNA, 453 bp, Homo sapiens; identical to SEQ ID NO: 554311
  misc_feature: HIJSMM301BCKMI.19.86.H09.1.454.light.4.raw

SEQ ID NO: 596333 - DNA, 498 bp, Homo sapiens
  misc_feature: HIJSMM301EPPEF.8.75.G09.1.454.light.4.raw
ctcgcgtgtccacgaccggtgctcgatttagtatagacatcaggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatcccttgttctggaagcagctccaacatcggaactaatactgtaaactggtaccagcaactcccaggaacggcccccaaactcctcatctatcatagtgatcagcggccctcaggggtccctgaccgattctctggctccaagtctgccacctcagcctccctggccatcagtgggctccagtctgaggatgaggctgattattactgtgcagcatgggatgacagcctgaatggcctggtattcggtggagggaccaaagtgaccgtcctaggtcagcccaaggctgccccctcc

SEQ ID NO: 596334 - DNA, 503 bp, Homo sapiens; identical to SEQ ID NO: 536834
  misc_feature: HIJSMM301DWSHP.2.35.D02.1.454.light.4.raw

SEQ ID NO: 596335 - DNA, 466 bp, Homo sapiens; identical to SEQ ID NO: 536398
  misc_feature: HIJSMM301EM4R6.3.20.B09.1.454.light.4.raw

SEQ ID NO: 596336 - DNA, 485 bp, Homo sapiens
  misc_feature: HIJSMM301B4WYG.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgagtccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 596337 - DNA, 485 bp, Homo sapiens
  misc_feature: HIJSMM301ARFCX.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcgggagggaccaagttgacgtcctaggtcagcccaaggctcg

SEQ ID NO: 596338 - DNA, 513 bp, Homo sapiens; identical to SEQ ID NO: 559106
  misc_feature: HIJSMM301BRO2P.11.57.F02.1.454.light.4.raw

SEQ ID NO: 596339 - DNA, 510 bp, Homo sapiens
  misc_feature: HIJSMM301BBH42.17.33.C11.1.454.light.4.raw
  modified_base (486)..(486): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcngccccctcggtcactctgttccca

SEQ ID NO: 596340 - DNA, 487 bp, Homo sapiens
  misc_feature: HIJSMM301CFED2.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttcggccagggaccaaactggacatcaaacgaactgtggctgcacatctgtt

SEQ ID NO: 596341 - DNA, 521 bp, Homo sapiens
  misc_feature: HIJSMM301EZ1LG.41.19.B08.1.454.light.4.raw
tctatactatcacgaccggtgctcgatttagtgagtcagtaaggggctggggtctcgaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcacctctgttcccaccctcct

SEQ ID NO: 596342 - DNA, 478 bp, Homo sapiens
  misc_feature: HIJSMM301EEPWO.17.29.C07.1.454.light.4.raw
cgtagactagcacgaccggtgctcgatttagagtgctacgaagggaaaggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaactcatcctttatgagggcactaagcggccctcaggggtttctaatcgcttctctggctccaagtctggcaacacggcctccctcaccatctctggactccagcctgaggacgaggctgattattactgcatctcatttgtaagcagtagccttgtgttattcggcggagggaccaagctgaccgtcctgggtcagcccaaggctcgcccccgtcggtccactctgttccccacccctcctcctagtctacg

SEQ ID NO: 596343 - DNA, 523 bp, Homo sapiens; identical to SEQ ID NO: 548013
  misc_feature: HIJSMM301DLV1U.27.23.C01.1.454.light.4.raw

SEQ ID NO: 596344 - DNA, 486 bp, Homo sapiens
  misc_feature: HIJSMM301BZBUO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaaactgtggctgcaccat

SEQ ID NO: 596345 - DNA, 515 bp, Homo sapiens
  misc_feature: HIJSMM301DTLI1.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctcgttcccaccctcctcgagtagtaca

SEQ ID NO: 596346 - DNA, 515 bp, Homo sapiens
  misc_feature: HIJSMM301DN748.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccccg

SEQ ID NO: 596347 - DNA, 512 bp, Homo sapiens
  misc_feature: HIJSMM301BG612.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtccactctgttcccaccctcctcgctacgt

SEQ ID NO: 596348 - DNA, 467 bp, Homo sapiens; identical to SEQ ID NO: 579907
  misc_feature: HIJSMM301CQ30M.11.70.G04.1.454.light.4.raw

SEQ ID NO: 596349 - DNA, 504 bp, Homo sapiens
  misc_feature: HIJSMM301DWUJ0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtgctgcaccatctgtcttcatcttccccg

SEQ ID NO: 596350 - DNA, 490 bp, Homo sapiens
  misc_feature: HIJSMM301EHA14.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattcctttactttcggccctgggaccaaagtggatatcaaacgaactgtggctgcaccat

SEQ ID NO: 596351 - DNA, 415 bp, Homo sapiens
  misc_feature: HIJSMM301EKUWP.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtataca

SEQ ID NO: 596352 - DNA, 489 bp, Homo sapiens; identical to SEQ ID NO: 548452
  misc_feature: HIJSMM301CSX4T.26.37.D04.1.454.light.4.raw

SEQ ID NO: 596353 - DNA, 493 bp, Homo sapiens
  misc_feature: HIJSMM301DNB59.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcgtatttattactgtcagcagtataataactggcctccacggtacacttttggccaggggaccaagctggagatcaaacgaactgtggctgcaccat

SEQ ID NO: 596354 - DNA, 508 bp, Homo sapiens
  misc_feature: HIJSMM301EJ71L.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtacaaacgaactagtggctgcaccatctcgtcttcatccttccccg

SEQ ID NO: 596355 - DNA, 494 bp, Homo sapiens
  misc_feature: HIJSMM301CHHBQ.51.78.H01.1.454.light.4.raw
cgatcgtatacacgaccggtgctcgatttagtgtgagtagtttgggtttggggagtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagattcactctcaccatcagcagtgtgcgacctgaagattttgcaacttactactgtcaacagagttacagtacccctcagctcactttcggcggagggaccaaggtggaggatacaaacgaaact

SEQ ID NO: 596356 - DNA, 504 bp, Homo sapiens; identical to SEQ ID NO: 555616
  misc_feature: HIJSMM301C18KK.5.86.H09.1.454.light.4.raw

SEQ ID NO: 596357 - DNA, 514 bp, Homo sapiens
  misc_feature: HIJSMM301AJXOI.13.55.E11.1.454.light.4.raw
tcacgtactacacgaccggtgctcgatttagcactcgcacgttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgtttgttcatatgcaggaaggagtgattatgtctttggaagtgggaccaaggtcaccgtccttggtcagcccaaggccaaccccactgtcactctgtt

SEQ ID NO: 596358 - DNA, 497 bp, Homo sapiens; identical to SEQ ID NO: 536072
  misc_feature: HIJSMM301BRBCK.16.78.H01.1.454.light.4.raw

SEQ ID NO: 596359 - DNA, 489 bp, Homo sapiens
  misc_feature: HIJSMM301EUQWI.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggtccaggggaccaagctggagatcaaacgaaactgtggctgcaccaat

SEQ ID NO: 596360 - DNA, 498 bp, Homo sapiens
  misc_feature: HIJSMM301CX9Q4.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 596361 - DNA, 486 bp, Homo sapiens; identical to SEQ ID NO: 535043
  misc_feature: HIJSMM301BV5VO.46.35.D02.1.454.light.4.raw

SEQ ID NO: 596362 - DNA, 494 bp, Homo sapiens; identical to SEQ ID NO: 535680
  misc_feature: HIJSMM301CF0J0.16.78.H01.1.454.light.4.raw

SEQ ID NO: 596363 - DNA, 507 bp, Homo sapiens
  misc_feature: HIJSMM301D5YYW.19.72.G06.1.454.light.4.raw
tactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctggtccact

SEQ ID NO: 596364 - DNA, 481 bp, Homo sapiens
  misc_feature: HIJSMM301B7NCP.48.60.F05.1.454.light.4.raw
  modified_base (447)..(447): a, c, t, g, unknown or other
agtatacatacacgaccggtgctcgatttagtacgtcatcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctcctgaccatctctgggctccaggctgaggatgaggctgattattactgctgctcatatgcaggcagctacactttggngttcggcggagggaccaaggctcgactgtacccg

SEQ ID NO: 596365 - DNA, 503 bp, Homo sapiens; identical to SEQ ID NO: 590269
  misc_feature: HIJSMM301EUQTD.17.27.C05.1.454.light.4.raw

SEQ ID NO: 596366 - DNA, 502 bp, Homo sapiens
  misc_feature: HIJSMM301BOC15.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaagggaccaaggcggaaagtacaaacgaactagtacggcgtg

SEQ ID NO: 596367 - DNA, 476 bp, Homo sapiens; identical to SEQ ID NO: 538026
  misc_feature: HIJSMM301CPKMU.13.76.G10.1.454.light.4.raw

SEQ ID NO: 596368 - DNA, 494 bp, Homo sapiens; identical to SEQ ID NO: 558118
  misc_feature: HIJSMM301BD2OR.8.81.H04.1.454.light.4.raw

SEQ ID NO: 596369 - DNA, 510 bp, Homo sapiens
  misc_feature: HIJSMM301D4DX1.26.72.G06.1.454.light.4.raw
  modified_base (482)..(482): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtctagcaatattttcgtgctccgtacacttttggccaggggacccaggtggagatcagactgatattaacagcgaaaaganattttgttaagggaaataatgaagttaa

SEQ ID NO: 596370 - DNA, 474 bp, Homo sapiens
  misc_feature: HIJSMM301EMP1S.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctctttccgatcacttttggtccaggggaccaggctggagat

SEQ ID NO: 596371 - DNA, 520 bp, Homo sapiens
  misc_feature: HIJSMM301C01Y4.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctccggtcactctgttcccacct

SEQ ID NO: 596372 - DNA, 459 bp, Homo sapiens
  misc_feature: HIJSMM301CKUZT.19.86.H09.1.454.light.4.raw
tactctcgtgcacgaccggtgctcgatttagtgctatagacttgggtttgggggccgttcctgggcccagtcttgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacgggttccggttttcggcggagggaccaagctgaccgtcctaagtcagcccaaggctcgccccctcggtcactctcgttcccaccctcctccacgagagta

SEQ ID NO: 596373 - DNA, 505 bp, Homo sapiens
  misc_feature: HIJSMM301BM04M.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgaccaatctctgggctccaggctgaggacgaggctgattattactgctgctcatatgcagatggtgacactcccgtggtattcggcggagggaccaaggtgaccgtctaggtcagcccaaggctgtccccccg

SEQ ID NO: 596374 - DNA, 498 bp, Homo sapiens
  misc_feature: HIJSMM301CHC13.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcgaccatctaccgtacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccacctcct

SEQ ID NO: 596375 - DNA, 495 bp, Homo sapiens; identical to SEQ ID NO: 540960
  misc_feature: HIJSMM301BNM8F.12.38.D05.1.454.light.4.raw

SEQ ID NO: 596376 - DNA, 473 bp, Homo sapiens
  misc_feature: HIJSMM301EPJZ3.15.81.H04.1.454.light.4.raw
  modified_base (448)..(448): a, c, t, g, unknown or other
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccacctcggtcactcngttcccaccctcctcgctacgtaga

SEQ ID NO: 596377 - DNA, 486 bp, Homo sapiens; identical to SEQ ID NO: 535043
  misc_feature: HIJSMM301AQZX7.46.35.D02.1.454.light.4.raw

SEQ ID NO: 596378 - DNA, 500 bp, Homo sapiens; identical to SEQ ID NO: 577922
  misc_feature: HIJSMM301CXAWC.18.59.F04.1.454.light.4.raw

SEQ ID NO: 596379 - DNA, 506 bp, Homo sapiens; identical to SEQ ID NO: 567467
  misc_feature: HIJSMM301AX0KC.7.71.G05.1.454.light.4.raw

SEQ ID NO: 596380 - DNA, 514 bp, Homo sapiens
  misc_feature: HIJSMM301AUO74.49.71.G05.1.454.light.4.raw
agtcgagagacacgaccggtgctcgatttagtgtcgtcgcaagagagagggggagtctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatagtggtagtggtgtcgtcttcggagctgggaccagggtcaccgtcctaggtcagcccaaggccaaccccactgtcactctgttcccaccct

SEQ ID NO: 596381 - DNA, 496 bp, Homo sapiens; identical to SEQ ID NO: 537925
  misc_feature: HIJSMM301ARPTI.22.14.B03.1.454.light.4.raw

SEQ ID NO: 596382 - DNA, 513 bp, Homo sapiens
  misc_feature: HIJSMM301CF2Z0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaagggaccaaacggtggaaatacaaaacgaactagtggctgcgaccatcctgtcttcattcttccccg

SEQ ID NO: 596383 - DNA, 493 bp, Homo sapiens
  misc_feature: HIJSMM301BJB5J.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccgaaggtggaagtacaagacgaacctgtggctgcaccatctgtt

SEQ ID NO: 596384 - DNA, 502 bp, Homo sapiens; identical to SEQ ID NO: 544940
  misc_feature: HIJSMM301A7XLA.9.53.E09.1.454.light.4.raw

SEQ ID NO: 596385 - DNA, 556 bp, Homo sapiens
  misc_feature: HIJSMM301CFVNO.14.57.F02.1.454.light.4.raw
cgtctagtaccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgcctcccctaccaacaacgcataagcgtcgctgccgcagcttcggtgcatggtttacgccccgttacatccttcccgccatcctgagtaactagacg

SEQ ID NO: 596386 - DNA, 505 bp, Homo sapiens; identical to SEQ ID NO: 535503
  misc_feature: HIJSMM301AVLW5.8.28.C06.1.454.light.4.raw

SEQ ID NO: 596387 - DNA, 483 bp, Homo sapiens
  misc_feature: HIJSMM301DWY59.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccgggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 596388 - DNA, 494 bp, Homo sapiens; identical to SEQ ID NO: 534992
  misc_feature: HIJSMM301EVHU7.9.1.A01.1.454.light.4.raw

SEQ ID NO: 596389 - DNA, 463 bp, Homo sapiens; identical to SEQ ID NO: 535062
  misc_feature: HIJSMM301BDA84.11.73.G07.1.454.light.4.raw

SEQ ID NO: 596390 - DNA, 509 bp, Homo sapiens
  misc_feature: HIJSMM301AU0ON.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctgggtgttcggcggagggaccaaactgaccgtcctaggtcagcccaaggctgccccctcggtcactctgttccccg

SEQ ID NO: 596391 - DNA, 503 bp, Homo sapiens
  misc_feature: HIJSMM301C3SS2.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctggtcta

SEQ ID NO: 596392 - DNA, 434 bp, Homo sapiens
  misc_feature: HIJSMM301DJB51.41.14.B03.1.454.light.4.raw
tctatactatcacgaccggtgctcgatttagtgtgagtagttccgcgggtagttccgcgggcacgaccggtgctcgatttagtacgctgtctttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 596393 - DNA, 506 bp, Homo sapiens
  misc_feature: HIJSMM301A9O64.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctggtcactctgttcccaccct

SEQ ID NO: 596394 - DNA, 494 bp, Homo sapiens; identical to SEQ ID NO: 539894
  misc_feature: HIJSMM301AYXYI.16.53.E09.1.454.light.4.raw

SEQ ID NO: 596395 - DNA, 491 bp, Homo sapiens; identical to SEQ ID NO: 542310
  misc_feature: HIJSMM301CBLRP.22.65.F10.1.454.light.4.raw

SEQ ID NO: 596396 - DNA, 488 bp, Homo sapiens
  misc_feature: HIJSMM301EJZ0Y.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctaagcagtctgaagattttgcactttattactgtcagcaatataatgactggttctcgatcaccttcggccaagggacgacgactggagattaaacgaactagtggctgcaccatct

SEQ ID NO: 596397 - DNA, 511 bp, Homo sapiens
  misc_feature: HIJSMM301AT55M.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactagtggctgcaccatctgtcttcatcttcccgccact

SEQ ID NO: 596398 - DNA, 500 bp, Homo sapiens
  misc_feature: HIJSMM301ENPYI.43.66.F11.1.454.light.4.raw
tgtgagtagtcacgaccggtgctcgatttagtcacgcgagaagggggaagagctgctcagttaggacccagagggaaccatggaaaccccagcgcagcttctcttcctcctgctactctggctcccagatcgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 596399 - DNA, 477 bp, Homo sapiens
  misc_feature: HIJSMM301ECNKH.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataaacagttattggacgttcggccgaagggaccaagggtggaaatcaaacgactagtggctgcacc

SEQ ID NO: 596400 - DNA, 495 bp, Homo sapiens; identical to SEQ ID NO: 536316
  misc_feature: HIJSMM301D4AF2.40.23.C01.1.454.light.4.raw

SEQ ID NO: 596401 - DNA, 514 bp, Homo sapiens
  misc_feature: HIJSMM301AW9Y4.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagacccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatggtggggggtgccacttgggtggttcggcggagggaccaagctgaccgtccg

SEQ ID NO: 596402 - DNA, 526 bp, Homo sapiens
  misc_feature: HIJSMM301DH7LH.41.41.D08.1.454.light.4.raw
tctatactatcacgaccggtgctcgatttagtcacgcgagaaagggaaagggggcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttccccg

SEQ ID NO: 596403 - DNA, 502 bp, Homo sapiens; identical to SEQ ID NO: 541971
  misc_feature: HIJSMM301B0S6Y.4.39.D06.1.454.light.4.raw

SEQ ID NO: 596404 - DNA, 491 bp, Homo sapiens; identical to SEQ ID NO: 543478
  misc_feature: HIJSMM301C58G0.14.55.E11.1.454.light.4.raw

SEQ ID NO: 596405 - DNA, 508 bp, Homo sapiens
  misc_feature: HIJSMM301DPE96.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtctaggtcagcccaaggctgccccctcggtcactctgttccccg

SEQ ID NO: 596406 - DNA, 454 bp, Homo sapiens; identical to SEQ ID NO: 536347
  misc_feature: HIJSMM301BSYY5.19.86.H09.1.454.light.4.raw

SEQ ID NO: 596407 - DNA, 483 bp, Homo sapiens; identical to SEQ ID NO: 545669
  misc_feature: HIJSMM301EN0Y2.13.8.A08.1.454.light.4.raw

SEQ ID NO: 596408 - DNA, 479 bp, Homo sapiens
  misc_feature: HIJSMM301BKLOJ.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtcccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 596409 - DNA, 492 bp, Homo sapiens; identical to SEQ ID NO: 557028
  misc_feature: HIJSMM301DQDAW.51.6.A06.1.454.light.4.raw

SEQ ID NO: 596410 - DNA, 487 bp, Homo sapiens; identical to SEQ ID NO: 540841
  misc_feature: HIJSMM301C6FSY.4.33.C11.1.454.light.4.raw

SEQ ID NO: 596411 - DNA, 494 bp, Homo sapiens
  misc_feature: HIJSMM301DFGDI.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggtcaggggaccaacctggagatcaaatgaactgtggctgacaccatctgtctt

SEQ ID NO: 596412 - DNA, 515 bp, Homo sapiens
  misc_feature: HIJSMM301A9RT5.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcgggcggagggaccaagctgaccgtccttggtcagcccaaggctgccccctcggtcactctgttcccgccct

SEQ ID NO: 596413 - DNA, 469 bp, Homo sapiens
  misc_feature: HIJSMM301DDIVM.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcgagggaccaaggtgagatcaacgaactgtgg

SEQ ID NO: 596414 - DNA, 499 bp, Homo sapiens
  misc_feature: HIJSMM301CJC23.19.78.H01.1.454.light.4.raw
  modified_base (494)..(494): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggccctcctgacaatctctgggctccaggctgaggacgaggctgattactactgctgctcatatgcaggtcgtatctcttatgtcttcggaactgggaccaaggtcacgtctaggtcagcccaaggccaacccntgtca

SEQ ID NO: 596415 - DNA, 491 bp, Homo sapiens
  misc_feature: HIJSMM301BHAF3.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccgaaggtggagatagaaaagaactgtggctgcaccat

SEQ ID NO: 596416 - DNA, 494 bp, Homo sapiens; identical to SEQ ID NO: 534992
  misc_feature: HIJSMM301BZOXC.9.1.A01.1.454.light.4.raw

SEQ ID NO: 596417 - DNA, 501 bp, Homo sapiens
  misc_feature: HIJSMM301B6OJ5.48.87.H10.1.454.light.4.raw
agtatacatacacgaccggtgctcgatttagcagtactgcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttcccg

SEQ ID NO: 596418 - DNA, 490 bp, Homo sapiens
  misc_feature: HIJSMM301COOBR.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggtccaggggaccgaagctggaggatcaaacgaaactgtgg

SEQ ID NO: 596419 - DNA, 507 bp, Homo sapiens; identical to SEQ ID NO: 536666
  misc_feature: HIJSMM301BACSD.11.57.F02.1.454.light.4.raw

SEQ ID NO: 596420 - DNA, 447 bp, Homo sapiens; identical to SEQ ID NO: 535201
  misc_feature: HIJSMM301B1YAR.18.9.A09.1.454.light.4.raw

SEQ ID NO: 596421 - DNA, 486 bp, Homo sapiens; identical to SEQ ID NO: 560708
  misc_feature: HIJSMM301C92YM.4.33.C11.1.454.light.4.raw

SEQ ID NO: 596422 - DNA, 484 bp, Homo sapiens
  misc_feature: HIJSMM301EC575.4.41.D08.1.454.light.4.raw
  modified_base (389)..(389): a, c, t, g, unknown or other
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagnttatgcaacttactattgtcagagttctaattctttcccgcgcacgtttggccaggggaccaaggtagagatcaaacgaactgtggctgcaccat

SEQ ID NO: 596423 - DNA, 485 bp, Homo sapiens; identical to SEQ ID NO: 546273
  misc_feature: HIJSMM301ANGJ3.43.36.D03.1.454.light.4.raw

SEQ ID NO: 596424 - DNA, 476 bp, Homo sapiens; identical to SEQ ID NO: 570296
  misc_feature: HIJSMM301B1O9K.40.1.A01.1.454.light.4.raw

SEQ ID NO: 596425 - DNA, 492 bp, Homo sapiens
  misc_feature: HIJSMM301CHBI2.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 596426 - DNA, 508 bp, Homo sapiens
  misc_feature: HIJSMM301C7G31.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgtacacgtctactaacgtaccgtcccgtctacttacgttcggacgggaacggaacggaggtaggatactaacgaaacgtacgt

SEQ ID NO: 596427 - DNA, 499 bp, Homo sapiens; identical to SEQ ID NO: 545732
  misc_feature: HIJSMM301EOXI6.3.33.C11.1.454.light.4.raw

SEQ ID NO: 596428 - DNA, 515 bp, Homo sapiens
  misc_feature: HIJSMM301CCK97.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccgccctcct

SEQ ID NO: 596429 - DNA, 501 bp, Homo sapiens
  misc_feature: HIJSMM301BF6OR.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaatgggaccaaggtcaccgtcctaggtcagcccaaggccaacccactgtca

SEQ ID NO: 596430 - DNA, 496 bp, Homo sapiens
  misc_feature: HIJSMM301BD9AX.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagccaaggctgccccctggt

SEQ ID NO: 596431 - DNA, 492 bp, Homo sapiens; identical to SEQ ID NO: 541313
  misc_feature: HIJSMM301B8XC6.9.1.A01.1.454.light.4.raw

SEQ ID NO: 596432 - DNA, 487 bp, Homo sapiens
  misc_feature: HIJSMM301COUOC.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggaggatcaaacgaactgtggctgcaccatctgtcttcatt

SEQ ID NO: 596433 - DNA, 500 bp, Homo sapiens
  misc_feature: HIJSMM301ECLB9.48.12.B01.1.454.light.4.raw
agtatacatacacgaccggtgctcgatttagtagtgtagattccgcgggcacgaccggtgctcgatttagtcacgcgagaaagggaaaggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacga

SEQ ID NO: 596434 - DNA, 482 bp, Homo sapiens
  misc_feature: HIJSMM301C2OK5.10.53.E09.1.454.light.4.raw
catagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaactccgggtccctgaccgattcagtggcagcgggtctgggacagatttcactctcaccatcagcagcctgcaggctgaagatgcggcagtttattactgtcagcactattatagtacccccattcacattcggccctgggaccaaagtggagatcaaacgaa

SEQ ID NO: 596435 - DNA, 501 bp, Homo sapiens; identical to SEQ ID NO: 579640
  misc_feature: HIJSMM301EQBBW.9.81.H04.1.454.light.4.raw

SEQ ID NO: 596436 - DNA, 440 bp, Homo sapiens
  misc_feature: HIJSMM301CYB4X.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtctaggtcagcccaaggctgccccctcggtcactctgttcccgccctcctcgtatctctcg

SEQ ID NO: 596437 - DNA, 470 bp, Homo sapiens
  misc_feature: HIJSMM301AV5HU.49.53.E09.1.454.light.4.raw
agtcgagagacacgaccggtgctcgatttagagagagtgtgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagacgaa

SEQ ID NO: 596438 - DNA, 486 bp, Homo sapiens; identical to SEQ ID NO: 535043
  misc_feature: HIJSMM301AL3UR.46.35.D02.1.454.light.4.raw

SEQ ID NO: 596439 - DNA, 470 bp, Homo sapiens; identical to SEQ ID NO: 555914
  misc_feature: HIJSMM301B0TCQ.4.79.H02.1.454.light.4.raw

SEQ ID NO: 596440 - DNA, 494 bp, Homo sapiens; identical to SEQ ID NO: 534994
  misc_feature: HIJSMM301BP5VF.27.78.H01.1.454.light.4.raw

SEQ ID NO: 596441 - DNA, 515 bp, Homo sapiens; identical to SEQ ID NO: 592944
  misc_feature: HIJSMM301AL4I7.15.57.F02.1.454.light.4.raw

SEQ ID NO: 596442 - DNA, 484 bp, Homo sapiens
  misc_feature: HIJSMM301DL5T1.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctg

SEQ ID NO: 596443 - DNA, 507 bp, Homo sapiens; identical to SEQ ID NO: 563344
  misc_feature: HIJSMM301AM0XZ.3.79.H02.1.454.light.4.raw

SEQ ID NO: 596444 - DNA, 493 bp, Homo sapiens
  misc_feature: HIJSMM301DOWJS.9.86.H09.1.454.light.4.raw
tgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccgccctcctcagacgtatca

SEQ ID NO: 596445 - DNA, 493 bp, Homo sapiens; identical to SEQ ID NO: 535084
  misc_feature: HIJSMM301CXU0A.47.64.F09.1.454.light.4.raw

SEQ ID NO: 596446 - DNA, 517 bp, Homo sapiens
  misc_feature: HIJSMM301ENO7U.13.33.C11.1.454.light.4.raw
tcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccaccctcctctagta

SEQ ID NO: 596447 - DNA, 482 bp, Homo sapiens; identical to SEQ ID NO: 548992
  misc_feature: HIJSMM301AZY23.51.64.F09.1.454.light.4.raw

SEQ ID NO: 596448 - DNA, 497 bp, Homo sapiens
  misc_feature: HIJSMM301C7APC.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccgggccagattgaggatgaggctgactattattgttactctgcggctgacaaccatctggttttcggcgggggaccaaggttgaccgtcgtgggtcagcccaaggctgccccctggtcactctcg

SEQ ID NO: 596449 - DNA, 512 bp, Homo sapiens; identical to SEQ ID NO: 552719
  misc_feature: HIJSMM301CSOVY.22.36.D03.1.454.light.4.raw

SEQ ID NO: 596450 - DNA, 504 bp, Homo sapiens
  misc_feature: HIJSMM301DPQR4.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcaacgaactgtggctgcaccatctgtcttcta

SEQ ID NO: 596451 - DNA, 487 bp, Homo sapiens
  misc_feature: HIJSMM301ADT1N.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaattcggtggagggaccaaggtggaggtcaaacgaactgtggctgcaccatctgtcttc

SEQ ID NO: 596452 - DNA, 486 bp, Homo sapiens
  misc_feature: HIJSMM301DNTK6.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatcccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 596453 - DNA, 510 bp, Homo sapiens; identical to SEQ ID NO: 536088
  misc_feature: HIJSMM301E0TJ9.15.34.D01.1.454.light.4.raw

SEQ ID NO: 596454 - DNA, 488 bp, Homo sapiens
  misc_feature: HIJSMM301DRTE1.3.12.B01.1.454.light.4.raw
agacgcactccacgaccggtgctcgatttagtagtgtagattccgcgggggagggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggaggatcaaacgaactgtggctgcaccat

SEQ ID NO: 596455 - DNA, 492 bp, Homo sapiens
  misc_feature: HIJSMM301EIMT7.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggcacgactggagattaaacgaactgtggctgcacatctgtctt

SEQ ID NO: 596456 - DNA, 447 bp, Homo sapiens; identical to SEQ ID NO: 535020
  misc_feature: HIJSMM301ADIP5.18.9.A09.1.454.light.4.raw

SEQ ID NO: 596457 - DNA, 484 bp, Homo sapiens; identical to SEQ ID NO: 536162
  misc_feature: HIJSMM301DFLSL.13.59.F04.1.454.light.4.raw

SEQ ID NO: 596458 - DNA, 513 bp, Homo sapiens
  misc_feature: HIJSMM301EWIWI.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccgccct

SEQ ID NO: 596459 - DNA, 488 bp, Homo sapiens
  misc_feature: HIJSMM301AVVYE.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggtccaaggaccgaagtgggatatcagacgaa

SEQ ID NO: 596460 - DNA, 515 bp, Homo sapiens
  misc_feature: HIJSMM301B1HEA.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtccactctgttccca

SEQ ID NO: 596461 - DNA, 520 bp, Homo sapiens; identical to SEQ ID NO: 540293
  misc_feature: HIJSMM301D4MG3.27.23.C01.1.454.light.4.raw

SEQ ID NO: 596462 - DNA, 508 bp, Homo sapiens; identical to SEQ ID NO: 584029
  misc_feature: HIJSMM301EPUC6.51.27.C05.1.454.light.4.raw

SEQ ID NO: 596463 - DNA, 498 bp, Homo sapiens
  misc_feature: HIJSMM301DP4W3.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcgggagggaccaaggtgaccgtcctacgtcagcccaaggctgccccctcggtcactctcg

SEQ ID NO: 596464 - DNA, 474 bp, Homo sapiens
  misc_feature: HIJSMM301CQR0T.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgcccccttcaccttcggccaagggacacgactggagattagacg

SEQ ID NO: 596465 - DNA, 481 bp, Homo sapiens
  misc_feature: HIJSMM301CT4JG.51.29.C07.1.454.light.4.raw
cgatcgtatacacgaccggtgctcgatttagagtgctacgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcacc

SEQ ID NO: 596466 - DNA, 483 bp, Homo sapiens
  misc_feature: HIJSMM301B7P1G.52.1.A01.1.454.light.4.raw
cgcagtacgacacgaccggtgctcgatttagacgtctcatcagggggccctgaagacttttttatgggctggtcgcaccctgtgcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccat

SEQ ID NO: 596467 - DNA, 507 bp, Homo sapiens
  misc_feature: HIJSMM301ECNAM.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccacttcggccctgggaccaagtgagtatcaaacgaactgtggctgcaccactctgtcttcta

SEQ ID NO: 596468 - DNA, 515 bp, Homo sapiens; identical to SEQ ID NO: 549865
  misc_feature: HIJSMM301D1TFR.16.66.F11.1.454.light.4.raw

SEQ ID NO: 596469 - DNA, 500 bp, Homo sapiens
  misc_feature: HIJSMM301BZNOL.53.5.A05.1.454.light.4.raw
cgcgtatacacacgaccggtgctcgatttagatagatagacagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgctttttcggcggagggaccaagctgaccgtcctacgtcagcccaaggctgccccctcggtcactctgttccccg

SEQ ID NO: 596470 - DNA, 490 bp, Homo sapiens
  misc_feature: HIJSMM301D0ERQ.51.69.G03.1.454.light.4.raw
  modified_base (431)..(431): a, c, t, g, unknown or other
cgatcgtatacacgaccggtgctcgatttagtcgctgcgtaaaggagaaagggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaaatatgctcgttggttccagcagaaggcgggccaggcccctgtcttgatgatttataaagacactgagcggccctcagggatccctgagcgattctccggctccagctcagggactacagtcaccttgaccatcagcggggcccaggttgacgatgaggctgactattactgttactctgcggctgacaacaattcngggatattcggcggagggaccaagctgaccgtcttaggtcagcccaaggctgccccctc

SEQ ID NO: 596471 - DNA, 495 bp, Homo sapiens
  misc_feature: HIJSMM301EOTF7.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggctagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgt

SEQ ID NO: 596472 - DNA, 489 bp, Homo sapiens; identical to SEQ ID NO: 554439
  misc_feature: HIJSMM301BF7EZ.14.55.E11.1.454.light.4.raw
  modified_base (427)..(427): a, c, t, g, unknown or other

SEQ ID NO: 596473 - DNA, 511 bp, Homo sapiens
  misc_feature: HIJSMM301A6O6R.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcacgaagtgaccgtcctcggtcagcccaaggctgccccctcggtcactc

SEQ ID NO: 596474 - DNA, 494 bp, Homo sapiens
  misc_feature: HIJSMM301AY6GA.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttaattactgtcaacatcgtaccgagtggcctccgggggccgacttcgtcctcggacgaacgtaggagtatataaacgaaactaagt

SEQ ID NO: 596475 - DNA, 493 bp, Homo sapiens
  misc_feature: HIJSMM301B287Z.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaggaactgtggctgcaccatctgtctctatcttccccg

SEQ ID NO: 596476 - DNA, 492 bp, Homo sapiens
  misc_feature: HIJSMM301AK05I.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccgccctcctgcacgtaga

SEQ ID NO: 596477 - DNA, 499 bp, Homo sapiens
  misc_feature: HIJSMM301D7U6Z.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcagaaagacagcttccctgaccatcactggggctcaggcggaagatgaggctgactattactgtaactccggacagcagtgctgaccaggtggtaattcggcggagggacccacctgaccgtcttaggtcagcccaaggctgccccctggtcta

SEQ ID NO: 596478 - DNA, 500 bp, Homo sapiens; identical to SEQ ID NO: 541872
  misc_feature: HIJSMM301DP35K.48.82.H05.1.454.light.4.raw

SEQ ID NO: 596479 - DNA, 486 bp, Homo sapiens; identical to SEQ ID NO: 537310
  misc_feature: HIJSMM301C6LVL.15.28.C06.1.454.light.4.raw

SEQ ID NO: 596480 - DNA, 508 bp, Homo sapiens
  misc_feature: HIJSMM301AP8Q7.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttccccg

SEQ ID NO: 596481 - DNA, 486 bp, Homo sapiens; identical to SEQ ID NO: 535043
  misc_feature: HIJSMM301A8OIH.46.35.D02.1.454.light.4.raw

SEQ ID NO: 596482 - DNA, 504 bp, Homo sapiens; identical to SEQ ID NO: 535495
  misc_feature: HIJSMM301D0JHT.14.86.H09.1.454.light.4.raw

SEQ ID NO: 596483 - DNA, 441 bp, Homo sapiens; identical to SEQ ID NO: 534971
  misc_feature: HIJSMM301AFHEO.11.3.A03.1.454.light.4.raw

SEQ ID NO: 596484 - DNA, 493 bp, Homo sapiens
  misc_feature: HIJSMM301AD2FS.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacatggcctccctgaccatctctgggctccagactgaggatgaggctacttatttttgctgctcttatgcaggcagtttcgctctcgaagtgttcggcggagggaccgagctgaccgtcctacgtcagccc

SEQ ID NO: 596485 - DNA, 511 bp, Homo sapiens; identical to SEQ ID NO: 546062
  misc_feature: HIJSMM301ARP0G.5.58.F03.1.454.light.4.raw

SEQ ID NO: 596486 - DNA, 497 bp, Homo sapiens
  misc_feature: HIJSMM301ETJX3.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagccaaggctgccccctcggtcactctcgtt

SEQ ID NO: 596487 - DNA, 519 bp, Homo sapiens; identical to SEQ ID NO: 547713
  misc_feature: HIJSMM301DYI48.5.27.C05.1.454.light.4.raw

SEQ ID NO: 596488 - DNA, 494 bp, Homo sapiens; identical to SEQ ID NO: 557656
  misc_feature: HIJSMM301CJUUZ.22.5.A05.1.454.light.4.raw

SEQ ID NO: 596489 - DNA, 488 bp, Homo sapiens
  misc_feature: HIJSMM301CDOXZ.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcggtggcagtggatctgggacagaattcacgctcaccatcatcaggctgcggtctgacgacttcgcagtctatttctgtcaacagtacgatggccggcctccgtggacattcggccaaggtaccaaggtggacatcagacgaactgtggctgcaccat

SEQ ID NO: 596490 - DNA, 494 bp, Homo sapiens; identical to SEQ ID NO: 543247
  misc_feature: HIJSMM301BME06.22.57.F02.1.454.light.4.raw

SEQ ID NO: 596491 - DNA, 495 bp, Homo sapiens; identical to SEQ ID NO: 562968
  misc_feature: HIJSMM301D6MNT.3.33.C11.1.454.light.4.raw

SEQ ID NO: 596492 - DNA, 511 bp, Homo sapiens
  misc_feature: HIJSMM301C0GG9.48.37.D04.1.454.light.4.raw
agtatacatacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcgggagggaccgaaggtggaggtcgaaacgaactgtggctgcaccatctgtctt

SEQ ID NO: 596493 - DNA, 475 bp, Homo sapiens
  misc_feature: HIJSMM301EWFIW.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggccggggggtaccaagggtggacatcaaacgaa

SEQ ID NO: 596494 - DNA, 496 bp, Homo sapiens; identical to SEQ ID NO: 550113
  misc_feature: HIJSMM301BQG92.16.6.A06.1.454.light.4.raw

SEQ ID NO: 596495 - DNA, 509 bp, Homo sapiens
  misc_feature: HIJSMM301ALZVY.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtaggagtatcaaacgaactagtggctgcaccatctgtctt

SEQ ID NO: 596496 - DNA, 497 bp, Homo sapiens; identical to SEQ ID NO: 535764
  misc_feature: HIJSMM301DPJ53.22.20.B09.1.454.light.4.raw

SEQ ID NO: 596497 - DNA, 489 bp, Homo sapiens; identical to SEQ ID NO: 535139
  misc_feature: HIJSMM301C0Y9O.14.55.E11.1.454.light.4.raw

SEQ ID NO: 596498 - DNA, 510 bp, Homo sapiens
  misc_feature: HIJSMM301EBMKD.8.21.B10.1.454.light.4.raw
ctcgcgtgtccacgaccggtgctcgatttagtgtcgtcgcaagagaggaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtcttcatcttcccgccatttg

SEQ ID NO: 596499 - DNA, 487 bp, Homo sapiens; identical to SEQ ID NO: 553099
  misc_feature: HIJSMM301EDS1N.13.5.A05.1.454.light.4.raw

SEQ ID NO: 596500 - DNA, 497 bp, Homo sapiens
  misc_feature: HIJSMM301A8R9L.14.55.E11.1.454.light.4.raw
  modified_base (453)..(453): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggaccgaagacggngatcagaacgaacctagtggcgtgtcaccaactctcgtcttcta

SEQ ID NO: 596501 - DNA, 503 bp, Homo sapiens; identical to SEQ ID NO: 551847
  misc_feature: HIJSMM301BTPKT.27.78.H01.1.454.light.4.raw
  modified_base (495)..(495): a, c, t, g, unknown or other

SEQ ID NO: 596502 - DNA, 455 bp, Homo sapiens
  misc_feature: HIJSMM301BME56.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctcgttcccaccctcctccatactcgta

SEQ ID NO: 596503 - DNA, 509 bp, Homo sapiens
  misc_feature: HIJSMM301DU01S.49.17.B06.1.454.light.4.raw
agtcgagagacacgaccggtgctcgatttagtcgatagtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacatggcctccctgaccatctctggcctccaggccgaggacgaggctgattattactgcagctcatatacaaccagcaacaattgggtgttcggcggagggaccaaactgaccgtctaggtcagcccaaggctgccccctcggtccactctgtt

SEQ ID NO: 596504 - DNA, 495 bp, Homo sapiens
  misc_feature: HIJSMM301EAF7O.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggacccgagggtgggaaagtacaaacgaaacctagtggctgcaccactctgtcttt

SEQ ID NO: 596505 - DNA, 485 bp, Homo sapiens
  misc_feature: HIJSMM301BS87G.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaggtggagatcaaacgaactgtggctgcaccat

SEQ ID NO: 596506 - DNA, 474 bp, Homo sapiens; identical to SEQ ID NO: 568211
  misc_feature: HIJSMM301DERS2.18.76.G10.1.454.light.4.raw

SEQ ID NO: 596507 - DNA, 491 bp, Homo sapiens
  misc_feature: HIJSMM301CVDZZ.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctgaagtattttgctagtttttactgtcagcagtatagtaactggcctccgtacactttggccaggggaccagctagaatcaaacgactgtgctgcaccatctgtctcta

SEQ ID NO: 596508 - DNA, 493 bp, Homo sapiens
  misc_feature: HIJSMM301D0YQW.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagtctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggcccaaccccactgtcactctgttccccaccctcctctacgtgagct

SEQ ID NO: 596509 - DNA, 502 bp, Homo sapiens; identical to SEQ ID NO: 541971
  misc_feature: HIJSMM301DPRA2.4.39.D06.1.454.light.4.raw

SEQ ID NO: 596510 - DNA, 518 bp, Homo sapiens; identical to SEQ ID NO: 580721
  misc_feature: HIJSMM301B6DYH.43.59.F04.1.454.light.4.raw

SEQ ID NO: 596511 - DNA, 504 bp, Homo sapiens
  misc_feature: HIJSMM301ADIW1.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccagggtggaaatacagacgaactgtggctgcaccat

SEQ ID NO: 596512 - DNA, 487 bp, Homo sapiens; identical to SEQ ID NO: 537079
  misc_feature: HIJSMM301CN8W9.14.55.E11.1.454.light.4.raw

SEQ ID NO: 596513 - DNA, 495 bp, Homo sapiens; identical to SEQ ID NO: 537716
  misc_feature: HIJSMM301DEMLE.22.14.B03.1.454.light.4.raw

SEQ ID NO: 596514 - DNA, 444 bp, Homo sapiens; identical to SEQ ID NO: 540477
  misc_feature: HIJSMM301CY54Q.17.21.B10.1.454.light.4.raw

SEQ ID NO: 596515 - DNA, 493 bp, Homo sapiens; identical to SEQ ID NO: 535047
  misc_feature: HIJSMM301DRZ55.16.53.E09.1.454.light.4.raw

SEQ ID NO: 596516 - DNA, 497 bp, Homo sapiens
  misc_feature: HIJSMM301AVW2Q.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacaggtccggactgaagacgaggctgactattactgcttgtctgggatgaggacacattggtgttcggcggagggaccaagctgaccgtcctacgtcagcccaaggctgccccctcggtcactctgtt

SEQ ID NO: 596517 - DNA, 504 bp, Homo sapiens
  misc_feature: HIJSMM301EHEZW.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggtccctcaggagtccctgaccgattctctgcctccaagtccggcacctcacgcctcctggccatcagtgggctccgggccgaggatgaggctgattattactgtgcaggatgggatgacaacctgggtgcttatctcttcggacctgggaccaaggtcaccgtccttggt

SEQ ID NO: 596518 - DNA, 509 bp, Homo sapiens
  misc_feature: HIJSMM301A2TRT.43.5.A05.1.454.light.4.raw
tgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggaggaccaagttgaccgtctaggtcagcccaaggctgccccctcggtcactctgttccccacctcctca

SEQ ID NO: 596519 - DNA, 504 bp, Homo sapiens; identical to SEQ ID NO: 567690
  misc_feature: HIJSMM301CFTW4.10.71.G05.1.454.light.4.raw

SEQ ID NO: 596520 - DNA, 487 bp, Homo sapiens
  misc_feature: HIJSMM301AK1LN.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggaccagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccca

SEQ ID NO: 596521 - DNA, 488 bp, Homo sapiens
  misc_feature: HIJSMM301DOQ9M.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgaccaacaatatgatatttattctccagcgttcgcgacgggacaaggtggaagtcaagcgaactgtggctgcaccatctgtt

SEQ ID NO: 596522 - DNA, 501 bp, Homo sapiens
  misc_feature: HIJSMM301C6WQX.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccgaaggtggaaatcaaacgaactagtggctgcacc

SEQ ID NO: 596523 - DNA, 488 bp, Homo sapiens
  misc_feature: HIJSMM301CGZ04.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctcggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaact

SEQ ID NO: 596524 - DNA, 504 bp, Homo sapiens; identical to SEQ ID NO: 540089
  misc_feature: HIJSMM301CEU8U.3.53.E09.1.454.light.4.raw

SEQ ID NO: 596525 - DNA, 515 bp, Homo sapiens
  misc_feature: HIJSMM301ELAZE.52.20.B09.1.454.light.4.raw
cgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtggttataactatgtctcctggtaccaacaccacccaggcaaagcccccaaactcatgatttatgatatcagtgatcggccctcaggggtttcgaatcgcttctctggctccaagtccggcaacacggcctccctgaccatctctgggctccaggccgaggacgaggctgattattattgcagctcatatacaaacaacaacaaattgggtgttcgggcggagggaccaagctgaccgtcctaggtcagcccaaggctgccccctcggtcactctgttccca

SEQ ID NO: 596526 - DNA, 485 bp, Homo sapiens; identical to SEQ ID NO: 536075
  misc_feature: HIJSMM301AKPWG.17.21.B10.1.454.light.4.raw

SEQ ID NO: 596527 - DNA, 486 bp, Homo sapiens; identical to SEQ ID NO: 537127
  misc_feature: HIJSMM301DPK32.3.77.G11.1.454.light.4.raw

SEQ ID NO: 596528 - DNA, 484 bp, Homo sapiens
  misc_feature: HIJSMM301EPTYD.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagatttgcaacttactattgtcaacaggctaacagtttccctttaatcttcggcctaagggacacgactggagattaaacgaactgtggctacacc

SEQ ID NO: 596529 - DNA, 481 bp, Homo sapiens
  misc_feature: HIJSMM301B8K5G.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactatactgctcagcatgggacaggcagcctccgtggtgtggtgatcggcggagggaccagggctgaccgtcctaggt

SEQ ID NO: 596530 - DNA, 494 bp, Homo sapiens; identical to SEQ ID NO: 534992
  misc_feature: HIJSMM301B842F.9.1.A01.1.454.light.4.raw

SEQ ID NO: 596531 - DNA, 472 bp, Homo sapiens; identical to SEQ ID NO: 536302
  misc_feature: HIJSMM301BGRS3.18.76.G10.1.454.light.4.raw

SEQ ID NO: 596532 - DNA, 496 bp, Homo sapiens; identical to SEQ ID NO: 535109
  misc_feature: HIJSMM301COCMB.16.78.H01.1.454.light.4.raw

SEQ ID NO: 596533 - DNA, 476 bp, Homo sapiens; identical to SEQ ID NO: 560169
  misc_feature: HIJSMM301D1YEV.12.1.A01.1.454.light.4.raw

SEQ ID NO: 596534 - DNA, 510 bp, Homo sapiens; identical to SEQ ID NO: 535474
  misc_feature: HIJSMM301BDDY7.17.33.C11.1.454.light.4.raw

SEQ ID NO: 596535 - DNA, 499 bp, Homo sapiens
  misc_feature: HIJSMM301EP5YI.48.53.E09.1.454.light.4.raw
agtatacatacacgaccggtgctcgatttagagagagtgtgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacc

SEQ ID NO: 596536 - DNA, 487 bp, Homo sapiens
  misc_feature: HIJSMM301DD53L.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcgggcggagggaccaaggttgaccgtcctaggtcagcccaaggctcg

SEQ ID NO: 596537 - DNA, 500 bp, Homo sapiens; identical to SEQ ID NO: 580224
  misc_feature: HIJSMM301A6XEY.51.9.A09.1.454.light.4.raw

SEQ ID NO: 596538 - DNA, 470 bp, Homo sapiens
  misc_feature: HIJSMM301COWNJ.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttcaccatcagcaggctgcagcctgaagatattgcaacatattactgtcaacagtatgatagtctcccgctcactttcggcggggggaccgaaggtggagatcaagcgaa

SEQ ID NO: 596539 - DNA, 486 bp, Homo sapiens; identical to SEQ ID NO: 543543
  misc_feature: HIJSMM301CTP5N.49.3.A03.1.454.light.4.raw

SEQ ID NO: 596540 - DNA, 515 bp, Homo sapiens
  misc_feature: HIJSMM301B3PQ6.48.78.H01.1.454.light.4.raw
agtatacatacacgaccggtgctcgatttagtgtgagtagtttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccctcct

SEQ ID NO: 596541 - DNA, 475 bp, Homo sapiens
  misc_feature: HIJSMM301DIQO7.15.81.H04.1.454.light.4.raw
tctacgtagccacgaccggtgctcgatttagtagtgtagattcgcgggggggggtctcaggaggcagcgctctcaggacatctccaccatgtcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgctacgtaga

SEQ ID NO: 596542 - DNA, 489 bp, Homo sapiens; identical to SEQ ID NO: 543840
  misc_feature: HIJSMM301E0DI6.12.88.H11.1.454.light.4.raw

SEQ ID NO: 596543 - DNA, 505 bp, Homo sapiens; identical to SEQ ID NO: 539292
  misc_feature: HIJSMM301AP4HK.19.85.H08.1.454.light.4.raw

SEQ ID NO: 596544 - DNA, 500 bp, Homo sapiens; identical to SEQ ID NO: 535310
  misc_feature: HIJSMM301BHSGQ.47.66.F11.1.454.light.4.raw

SEQ ID NO: 596545 - DNA, 433 bp, Homo sapiens; identical to SEQ ID NO: 535337
  misc_feature: HIJSMM301EG3T9.18.5.A05.1.454.light.4.raw

SEQ ID NO: 596546 - DNA, 493 bp, Homo sapiens
  misc_feature: HIJSMM301CHRQI.14.53.E09.1.454.light.4.raw
cgtctagtaccacgaccggtgctcgatttagagagagtgtgttgggtttggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggt

SEQ ID NO: 596547 - DNA, 480 bp, Homo sapiens
  misc_feature: HIJSMM301A376A.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgctaattattactgtctgcaggattacacgataccctcgaaacgttcggcctaagggacccaaggtacggtaaatacaaacgaactacgt

SEQ ID NO: 596548 - DNA, 487 bp, Homo sapiens; identical to SEQ ID NO: 536536
  misc_feature: HIJSMM301EDCM6.26.45.E01.1.454.light.4.raw

SEQ ID NO: 596549 - DNA, 489 bp, Homo sapiens
  misc_feature: HIJSMM301CPN8G.52.37.D04.1.454.light.4.raw
cgcagtacgacacgaccggtgctcgatttagtagcatactgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcagtttgggtgttcgggcggagggaccaaggttgaccgtcctaggtcagcccaaggctccg

SEQ ID NO: 596550 - DNA, 492 bp, Homo sapiens
  misc_feature: HIJSMM301BKXK1.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaacgtcagaacatttgggtgttcggcggagggaccaagctgaccgtcctcagtcagacccg

SEQ ID NO: 596551 - DNA, 522 bp, Homo sapiens; identical to SEQ ID NO: 539966
  misc_feature: HIJSMM301AW08Q.27.23.C01.1.454.light.4.raw

SEQ ID NO: 596552 - DNA, 516 bp, Homo sapiens
  misc_feature: HIJSMM301EQUG9.15.34.D01.1.454.light.4.raw
  modified_base (421)..(421): a, c, t, g, unknown or other
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaaagctgccctcaccatcacgggggcccaggcagacgatgaatgtgattatcactncgtcctttatgtggggcgtggcatttgggtgttcggcggagggaccgaaactgaccgtcctaggtcagcccaagctgccccctcggtcactctcg

SEQ ID NO: 596553 - DNA, 490 bp, Homo sapiens; identical to SEQ ID NO: 543909
  misc_feature: HIJSMM301EYCL9.14.55.E11.1.454.light.4.raw

SEQ ID NO: 596554 - DNA, 521 bp, Homo sapiens
  misc_feature: HIJSMM301CCUQL.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagccccaaggccaaccccactgtcactctgttcccaccctcct

SEQ ID NO: 596555 - DNA, 503 bp, Homo sapiens; identical to SEQ ID NO: 543109
  misc_feature: HIJSMM301EIAPH.19.78.H01.1.454.light.4.raw

SEQ ID NO: 596556 - DNA, 488 bp, Homo sapiens; identical to SEQ ID NO: 574551
  misc_feature: HIJSMM301CBD1Q.47.36.D03.1.454.light.4.raw

SEQ ID NO: 596557 - DNA, 495 bp, Homo sapiens
  misc_feature: HIJSMM301AI58D.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggcaggggaccaagctggagatcaaacgaactgtggctgcaccatctgt

SEQ ID NO: 596558 - DNA, 416 bp, Homo sapiens; identical to SEQ ID NO: 545902
  misc_feature: HIJSMM301AD2ZU.18.78.H01.1.454.light.4.raw

SEQ ID NO: 596559 - DNA, 518 bp, Homo sapiens
  misc_feature: HIJSMM301BVLL1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggatcaggctgaccgtcctaggtcagcccaaggctgccccctcggtcactctgttcccta

SEQ ID NO: 596560 - DNA, 491 bp, Homo sapiens; identical to SEQ ID NO: 553956
  misc_feature: HIJSMM301CE9UX.4.22.B11.1.454.light.4.raw

SEQ ID NO: 596561 - DNA, 488 bp, Homo sapiens
  misc_feature: HIJSMM301DIB8L.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaa

SEQ ID NO: 596562 - DNA, 516 bp, Homo sapiens
  misc_feature: HIJSMM301C0K7E.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcaacccaaggctggcccctggtcact

SEQ ID NO: 596563 - DNA, 490 bp, Homo sapiens; identical to SEQ ID NO: 538273
  misc_feature: HIJSMM301EEC5O.16.73.G07.1.454.light.4.raw

SEQ ID NO: 596564 - DNA, 519 bp, Homo sapiens
  misc_feature: HIJSMM301EE2L5.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctcgccccctcggtcactctgttcccgccctcctcacg

SEQ ID NO: 596565 - DNA, 497 bp, Homo sapiens
  misc_feature: HIJSMM301E4BHG.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgccccctcggtcactctgttcccaccctcctccactactat

SEQ ID NO: 596566 - DNA, 509 bp, Homo sapiens
  misc_feature: HIJSMM301BJHJ2.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcaggtgggctccggtccgaggatgaggctgactattactgtgcatcacggggacgcaacatgggatgacaatctgagcggttgggtgttcggcggagggaaccaaactgacccgttcctaggtccagcccaa

SEQ ID NO: 596567 - DNA, 494 bp, Homo sapiens; identical to SEQ ID NO: 534994
  misc_feature: HIJSMM301A4M9B.27.78.H01.1.454.light.4.raw

SEQ ID NO: 596568 - DNA, 486 bp, Homo sapiens
  misc_feature: HIJSMM301AXU36.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccagggaccaaggtggaaatcaaacgaactgtggctgcaccatctgtcttcta

SEQ ID NO: 596569 - DNA, 490 bp, Homo sapiens
  misc_feature: HIJSMM301BJ1ID.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggccaagggaccaaggtggaaatcaaacgaactagtggctgcaccat

SEQ ID NO: 596570 - DNA, 501 bp, Homo sapiens; identical to SEQ ID NO: 553272
  misc_feature: HIJSMM301AYMYD.43.34.D01.1.454.light.4.raw

SEQ ID NO: 596571 - DNA, 499 bp, Homo sapiens
  misc_feature: HIJSMM301DZD9E.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctcctggccatcagtgggctccggtccgaggatgaggctgattattactgtgttggatgggacagcagcctgagtgcttatgtcttcggaactgggaccacggtcaccgtctaggt

SEQ ID NO: 596572 - DNA, 498 bp, Homo sapiens
  misc_feature: HIJSMM301CLMRZ.40.81.H04.1.454.light.4.raw
tctagcgactcacgaccggtgctcgatttagtagtgtagattcgcgggcgtagactttgtgtttctcgtaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttatactgcatgcaacctctacaaactgtgtggacggtcggccaagggaccaaggtggaaatcaagcgaactgtggctgcaccatctgtcttcatcttccccg

SEQ ID NO: 596573 - DNA, 517 bp, Homo sapiens
  misc_feature: HIJSMM301AKQIJ.49.26.C04.1.454.light.4.raw
  modified_base (235)..(235): a, c, t, g, unknown or other
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagntatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctcgttcccgccccctct

SEQ ID NO: 596574 - DNA, 512 bp, Homo sapiens
  misc_feature: HIJSMM301AEGDW.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccactcatcattatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggtttcggtcggaggcaccgaagtgaccgtcctcggtcagccaaggctgccccctcggtcactctcg

SEQ ID NO: 596575 - DNA, 510 bp, Homo sapiens; identical to SEQ ID NO: 535474
  misc_feature: HIJSMM301BBAGH.17.33.C11.1.454.light.4.raw

SEQ ID NO: 596576 - DNA, 503 bp, Homo sapiens
  misc_feature: HIJSMM301ARPZB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgtccaagggaccaaggtaggaagtcaaacgaactagtggctgcaccatctgtcttcatcttccccg

SEQ ID NO: 596577 - DNA, 518 bp, Homo sapiens
  misc_feature: HIJSMM301CBXVH.51.26.C04.1.454.light.4.raw
cgatcgtatacacgaccggtgctcgatttagtctagcgactttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcgggagggaccaaactgaccgtctaggtcagcccaaggctgccccctcggtcactctgttccccg

SEQ ID NO: 596578 - DNA, 518 bp, Homo sapiens
  misc_feature: HIJSMM301BA90W.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaatttgatggccaaggacggttgggtgttcggcggagggaccaagctgaccgtcctaggtcagcccaaggctgccccctcggtcactctgttccccgccctcctcgctacgtagac

SEQ ID NO: 596579 - DNA, 488 bp, Homo sapiens; identical to SEQ ID NO: 551155
  misc_feature: HIJSMM301AWYV3.3.33.C11.1.454.light.4.raw

SEQ ID NO: 596580 - DNA, 506 bp, Homo sapiens; identical to SEQ ID NO: 540748
  misc_feature: HIJSMM301DI8A4.18.37.D04.1.454.light.4.raw

SEQ ID NO: 596581 - DNA, 488 bp, Homo sapiens; identical to SEQ ID NO: 562926
  misc_feature: HIJSMM301CX7AH.13.46.E02.1.454.light.4.raw

SEQ ID NO: 596582 - DNA, 501 bp, Homo sapiens; identical to SEQ ID NO: 562523
  misc_feature: HIJSMM301A8H5Q.43.34.D01.1.454.light.4.raw

SEQ ID NO: 596583 - DNA, 506 bp, Homo sapiens
  misc_feature: HIJSMM301E01TQ.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccattctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgtccccccg

SEQ ID NO: 596584 - DNA, 500 bp, Homo sapiens
  misc_feature: HIJSMM301DF349.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagccaaggctgccccctc

SEQ ID NO: 596585 - DNA, 485 bp, Homo sapiens; identical to SEQ ID NO: 536630
  misc_feature: HIJSMM301CD28U.13.56.F01.1.454.light.4.raw

SEQ ID NO: 596586 - DNA, 487 bp, Homo sapiens
  misc_feature: HIJSMM301EH708.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagtagccaggccagtcccctgtattggtcatctatcaagatgtgaagcggccctcagggatccctgagcgattctctggctccaactctgggaacgcagccactctgaccatcagcgggacccaggctatggatgagctgactattattgtcaggcgtgggacagcagcactgcccgttatgtcttcggaatgggaccaaggtcaccgtcttgagtcagcccaaggcccaa

SEQ ID NO: 596587 - DNA, 486 bp, Homo sapiens; identical to SEQ ID NO: 535043
  misc_feature: HIJSMM301BEV9W.46.35.D02.1.454.light.4.raw

SEQ ID NO: 596588 - DNA, 485 bp, Homo sapiens
  misc_feature: HIJSMM301DTHU7.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccgaaggtggagatcaaacgaactagtggcgtgcaccta

SEQ ID NO: 596589 - DNA, 486 bp, Homo sapiens
  misc_feature: HIJSMM301EC8D9.5.42.D09.1.454.light.4.raw
atcagacacgcacgaccggtgctcgatttagacacatacgcagggaaaggggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcaccatctgtt

SEQ ID NO: 596590 - DNA, 465 bp, Homo sapiens; identical to SEQ ID NO: 538589
  misc_feature: HIJSMM301BUDVN.12.39.D06.1.454.light.4.raw

SEQ ID NO: 596591 - DNA, 495 bp, Homo sapiens
  misc_feature: HIJSMM301CV3C9.4.27.C05.1.454.light.4.raw
agcactgtagcacgaccggtgctcgatttagacgcgatcgaagggtttgggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgacccatcagcgggacccaacttttagatgaggccgactatttctgtcacacgtgggacatgggcactgcgatcttcggcggagggaccaagctgaccgtcctggtcagcccaaggctgccccctcggtcact

SEQ ID NO: 596592 - DNA, 496 bp, Homo sapiens
  misc_feature: HIJSMM301DKD5L.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaacactttttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtggctgca

SEQ ID NO: 596593 - DNA, 516 bp, Homo sapiens; identical to SEQ ID NO: 553885
  misc_feature: HIJSMM301D31SX.22.36.D03.1.454.light.4.raw

SEQ ID NO: 596594 - DNA, 502 bp, Homo sapiens
  misc_feature: HIJSMM301B6JMT.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcgggaattggggacacggttcaccgtcctaggtcagcccaaggcccaacccc

SEQ ID NO: 596595 - DNA, 509 bp, Homo sapiens
  misc_feature: HIJSMM301ARLUG.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgtttcactttcggcggagggaccaaggtggacctcaaacgaactgtggctgcaccatctgtcttcatcttcccgccatc

SEQ ID NO: 596596 - DNA, 498 bp, Homo sapiens
  misc_feature: HIJSMM301DHHW4.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgttcagcagtataataactggcctccacggtacacttttggccaggggaccaagctggagatcaaacgaactgtggctgcaccatctgtt

SEQ ID NO: 596597 - DNA, 499 bp, Homo sapiens
  misc_feature: HIJSMM301BENIE.51.14.B03.1.454.light.4.raw
  modified_base (287)..(287): a, c, t, g, unknown or other
  modified_base (295)..(295): a, c, t, g, unknown or other
cgatcgtatacacgaccggtgctcgatttagtgtgagtagttccgcgggggcaggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgntaaaactntgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactgtggctgcaccatctgtcttcta

SEQ ID NO: 596598 - DNA, 501 bp, Homo sapiens; identical to SEQ ID NO: 548645
  misc_feature: HIJSMM301CG14Y.14.23.C01.1.454.light.4.raw

SEQ ID NO: 596599 - DNA, 522 bp, Homo sapiens
  misc_feature: HIJSMM301CQBK6.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgttccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 596600 - DNA, 498 bp, Homo sapiens
  misc_feature: HIJSMM301BKSFC.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctggtcagcccaaggctgccccctcggtcactctgttcccaccctcctctgtcgagcgt

SEQ ID NO: 596601 - DNA, 482 bp, Homo sapiens
  misc_feature: HIJSMM301C5ACX.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtctaggtcagcccaaggctgccccc

SEQ ID NO: 596602 - DNA, 502 bp, Homo sapiens; identical to SEQ ID NO: 541971
  misc_feature: HIJSMM301CPKWJ.4.39.D06.1.454.light.4.raw

SEQ ID NO: 596603 - DNA, 507 bp, Homo sapiens
  misc_feature: HIJSMM301DVNTV.10.29.C07.1.454.light.4.raw
catagtagtgcacgaccggtgctcgatttagagtgctacgaagggaaagggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtca

SEQ ID NO: 596604 - DNA, 493 bp, Homo sapiens
  misc_feature: HIJSMM301BX1E2.4.52.E08.1.454.light.4.raw
agcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggtattttgctagtttattactgtcagcagcgtagcaactggcctctgctcactttcggcggaggaccgaaggtggagatacaaacgaactgtggctgcaccta

SEQ ID NO: 596605 - DNA, 482 bp, Homo sapiens
  misc_feature: HIJSMM301C53VX.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgccccaaccttcggccagggacacgactggagattaacgaactgtggctgcaccatctgt

SEQ ID NO: 596606 - DNA, 485 bp, Homo sapiens; identical to SEQ ID NO: 551592
  misc_feature: HIJSMM301CFDRC.47.62.F07.1.454.light.4.raw

SEQ ID NO: 596607 - DNA, 492 bp, Homo sapiens
  misc_feature: HIJSMM301CX5F9.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcgccggagggaccgaaggtggagatcaaacgaa

SEQ ID NO: 596608 - DNA, 502 bp, Homo sapiens; identical to SEQ ID NO: 537363
  misc_feature: HIJSMM301ERF9L.18.23.C01.1.454.light.4.raw

SEQ ID NO: 596609 - DNA, 497 bp, Homo sapiens; identical to SEQ ID NO: 536376
  misc_feature: HIJSMM301DYE6J.22.9.A09.1.454.light.4.raw

SEQ ID NO: 596610 - DNA, 512 bp, Homo sapiens
  misc_feature: HIJSMM301EE0M6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtggaaagtacaaacgaactagtggcgtgcaccaactctgtcttctatcttccccg

SEQ ID NO: 596611 - DNA, 513 bp, Homo sapiens
  misc_feature: HIJSMM301BUNWO.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgcccctcggtcactctgttccccg

SEQ ID NO: 596612 - DNA, 492 bp, Homo sapiens; identical to SEQ ID NO: 537395
  misc_feature: HIJSMM301CEST6.16.73.G07.1.454.light.4.raw

SEQ ID NO: 596613 - DNA, 517 bp, Homo sapiens; identical to SEQ ID NO: 569951
  misc_feature: HIJSMM301CUPP9.19.80.H03.1.454.light.4.raw

SEQ ID NO: 596614 - DNA, 496 bp, Homo sapiens
  misc_feature: HIJSMM301BWMBW.27.78.H01.1.454.light.4.raw
  modified_base (364)..(364): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggaccacatttcaccctnaccatcaatagcctggaagctgaagatgctgcaacttattactgtcatcagagtactactttacctcaagtgatcaccttcggccaagggacacgactggagattaaacgaactgtggctgcaccatctgtt

SEQ ID NO: 596615 - DNA, 507 bp, Homo sapiens
  misc_feature: HIJSMM301BPUGR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccaagggaccgaaggtagggaaatacaaacgaactgtaggctgcaccatctgtcttctatcttccccg

SEQ ID NO: 596616 - DNA, 487 bp, Homo sapiens; identical to SEQ ID NO: 536206
  misc_feature: HIJSMM301BXSVR.47.38.D05.1.454.light.4.raw

SEQ ID NO: 596617 - DNA, 497 bp, Homo sapiens; identical to SEQ ID NO: 577513
  misc_feature: HIJSMM301BCIV2.4.27.C05.1.454.light.4.raw

SEQ ID NO: 596618 - DNA, 507 bp, Homo sapiens
  misc_feature: HIJSMM301BMFAG.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtgggcaggtcagcccaaggccaacccactgtcactctgtt

SEQ ID NO: 596619 - DNA, 490 bp, Homo sapiens
  misc_feature: HIJSMM301E34MQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaaggcggaggatcagacgaactgtggctgcaccatctgtcttcta

SEQ ID NO: 596620 - DNA, 505 bp, Homo sapiens; identical to SEQ ID NO: 581944
  misc_feature: HIJSMM301AK0OU.40.34.D01.1.454.light.4.raw

SEQ ID NO: 596621 - DNA, 479 bp, Homo sapiens
  misc_feature: HIJSMM301AGAGC.48.38.D05.1.454.light.4.raw
agtatacatacacgaccggtgctcgatttagtatctgatagttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 596622 - DNA, 516 bp, Homo sapiens; identical to SEQ ID NO: 567355
  misc_feature: HIJSMM301APO9G.10.86.H09.1.454.light.4.raw

SEQ ID NO: 596623 - DNA, 496 bp, Homo sapiens
  misc_feature: HIJSMM301B3PRN.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctg

SEQ ID NO: 596624 - DNA, 519 bp, Homo sapiens
  misc_feature: HIJSMM301EVBQN.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggacgaacggaggaagtacgaaacgaaacgagtaggcgtgcaccactactctcgttctatccttcccgtcccact

SEQ ID NO: 596625 - DNA, 494 bp, Homo sapiens; identical to SEQ ID NO: 534992
  misc_feature: HIJSMM301COZ3H.9.1.A01.1.454.light.4.raw

SEQ ID NO: 596626 - DNA, 508 bp, Homo sapiens
  misc_feature: HIJSMM301D65YN.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatcttcccgccactcg

SEQ ID NO: 596627 - DNA, 447 bp, Homo sapiens; identical to SEQ ID NO: 535020
  misc_feature: HIJSMM301EDGMH.18.9.A09.1.454.light.4.raw

SEQ ID NO: 596628 - DNA, 513 bp, Homo sapiens
  misc_feature: HIJSMM301BW209.48.38.D05.1.454.light.4.raw
agtatacatacacgaccggtgctcgatttagtatctgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagtgaccctccaggatccctgcgaggttctctggatcgaactcagggacattggccaccttgactatcacgtggggcccaggtggaggatgaaggtgactacttctgtttctcaacagacaccagtgacaatcatgcgtattttcggcggagggaccaagctgaccgtccgtgggtcacgcccaaggcctcgccccctcggtcactctcgtt

SEQ ID NO: 596629 - DNA, 489 bp, Homo sapiens
  misc_feature: HIJSMM301C4NIE.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccccaagaacttttggccaggggaccaagctggaggatcaaacgaactagtggctgcaccat

SEQ ID NO: 596630 - DNA, 510 bp, Homo sapiens
  misc_feature: HIJSMM301DNRVA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaacggaccgaaggtaggaagtacaaacgaactagtggctgcaccatctgtcttctactcttcccgtccact

SEQ ID NO: 596631 - DNA, 511 bp, Homo sapiens; identical to SEQ ID NO: 537464
  misc_feature: HIJSMM301A6Q0I.7.34.D01.1.454.light.4.raw

SEQ ID NO: 596632 - DNA, 505 bp, Homo sapiens
  misc_feature: HIJSMM301ARKLX.5.86.H09.1.454.light.4.raw
atcagacacgcacgaccggtgctcgatttagtgctatagacttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 596633 - DNA, 483 bp, Homo sapiens
  misc_feature: HIJSMM301CGB3M.49.26.C04.1.454.light.4.raw
  modified_base (392)..(392): a, c, t, g, unknown or other
  modified_base (421)..(421): a, c, t, g, unknown or other
  modified_base (461)..(461): a, c, t, g, unknown or other
  modified_base (476)..(476): a, c, t, g, unknown or other
agtcgagagacacgaccggtgctcgatttagtctagcgactttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttctaccactcagcaggctgcagcctgaagatattgnaacatattactgtcaacagtatgatagtntcccgctcacttcgtcggggccggaacggtaggagagtanagacgaacgagtggngtgcaca

SEQ ID NO: 596634 - DNA, 485 bp, Homo sapiens; identical to SEQ ID NO: 593029
  misc_feature: HIJSMM301D7679.3.10.A10.1.454.light.4.raw

SEQ ID NO: 596635 - DNA, 493 bp, Homo sapiens; identical to SEQ ID NO: 537422
  misc_feature: HIJSMM301E09RD.9.34.D01.1.454.light.4.raw

SEQ ID NO: 596636 - DNA, 508 bp, Homo sapiens
  misc_feature: HIJSMM301CA5Y4.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggccgtcgaccactctgtcttctatcttcccgt

SEQ ID NO: 596637 - DNA, 485 bp, Homo sapiens; identical to SEQ ID NO: 536040
  misc_feature: HIJSMM301AN4HP.15.1.A01.1.454.light.4.raw

SEQ ID NO: 596638 - DNA, 461 bp, Homo sapiens
  misc_feature: HIJSMM301EXMFQ.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctccgctcactttcggcgggggaccgaaggtggagatcaagcgaa

SEQ ID NO: 596639 - DNA, 483 bp, Homo sapiens; identical to SEQ ID NO: 541708
  misc_feature: HIJSMM301BX10R.43.50.E06.1.454.light.4.raw

SEQ ID NO: 596640 - DNA, 491 bp, Homo sapiens
  misc_feature: HIJSMM301AIRFG.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcgggagggaccaagctgaccgtccttggtcagcccaaggctcgtccccccg

SEQ ID NO: 596641 - DNA, 526 bp, Homo sapiens
  misc_feature: HIJSMM301A1Q4K.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctggaggacgaggctgattattattgtagttcatattacaaccagtgacacttgggtgttcggcggagggaccaggctgaccgtctaggtcagcccaaggctggtccccctcggtcactcctgttcccaccct

SEQ ID NO: 596642 - DNA, 478 bp, Homo sapiens
  misc_feature: HIJSMM301D0V4N.49.45.E01.1.454.light.4.raw
agtcgagagacacgaccggtgctcgatttagtgagtcagtaagggaaaggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttgagatggtatcaacagaaaccagggaaagcccctaaaactcctgatctatgctacattcgttttacaaagtggggtcccatcaaggttcagtggcagtggatctgggacagatttcactctcactatcagcagcctgcagcctgaagattttgcaacttattattgccatcaattgatgcttacccgctcactttcggcggagggaccaaaggtggagatcagacgaaactgtggcgtgca

SEQ ID NO: 596643 - DNA, 472 bp, Homo sapiens; identical to SEQ ID NO: 536302
  misc_feature: HIJSMM301CJNH0.18.76.G10.1.454.light.4.raw

SEQ ID NO: 596644 - DNA, 495 bp, Homo sapiens
  misc_feature: HIJSMM301EE5BS.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgacttagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgcaccta
